(12) United States Patent
Carlson et al.

(10) Patent No.: US 12,084,484 B2
(45) Date of Patent: Sep. 10, 2024

(54) INTERLEUKIN-2 AGENTS AND USES THEREOF

(71) Applicant: VISTERRA, INC., Waltham, MA (US)

(72) Inventors: Scott Moore Carlson, Boston, MA (US); Gregory Babcock, Marlborough, MA (US); Zachary Shriver, Winchester, MA (US); Boopathy Ramakrishnan, Braintree, MA (US)

(73) Assignee: Visterra, Inc., Waltham, MA (US)

( * ) Notice: Subject to any disclaimer, the term of this patent is extended or adjusted under 35 U.S.C. 154(b) by 247 days.

(21) Appl. No.: 16/937,993

(22) Filed: Jul. 24, 2020

(65) Prior Publication Data

US 2021/0024601 A1    Jan. 28, 2021

Related U.S. Application Data

(60) Provisional application No. 62/983,061, filed on Feb. 28, 2020, provisional application No. 62/879,137, filed on Jul. 26, 2019.

(51) Int. Cl.
| | |
|---|---|
| *C07K 14/55* | (2006.01) |
| *A61P 13/12* | (2006.01) |
| *C07K 16/24* | (2006.01) |
| *A61K 38/00* | (2006.01) |
| *A61K 39/00* | (2006.01) |

(52) U.S. Cl.
CPC .............. *C07K 14/55* (2013.01); *A61P 13/12* (2018.01); *C07K 16/246* (2013.01); *A61K 38/00* (2013.01); *A61K 2039/505* (2013.01); *C07K 2319/31* (2013.01)

(58) Field of Classification Search
CPC .................................................... C07K 14/55
See application file for complete search history.

(56) References Cited

U.S. PATENT DOCUMENTS

| | | | |
|---|---|---|---|
| 4,908,433 A | 3/1990 | Mertelsmann et al. | |
| 5,466,447 A | 11/1995 | Abels | |
| 5,525,491 A | 6/1996 | Huston et al. | |
| 7,569,215 B2 | 8/2009 | Wittrup | |
| 7,951,360 B2 | 5/2011 | Wittrup | |
| 8,349,311 B2 | 1/2013 | Wittrup | |
| 9,266,938 B2 | 2/2016 | Ast | |
| 9,289,493 B2 | 3/2016 | Ko | |
| 9,359,415 B2 | 6/2016 | Alvarez | |
| 9,428,563 B2 | 8/2016 | Alvarez | |
| 9,447,159 B2 | 9/2016 | Ast | |
| 9,546,203 B2 | 1/2017 | Kannan | |
| 9,580,486 B2 | 2/2017 | Gavin et al. | |
| 9,616,105 B2 | 4/2017 | Paulson | |
| 9,669,071 B2 | 6/2017 | Klatzmann | |
| 9,732,134 B2 | 8/2017 | Gavin | |
| 9,844,582 B2 | 12/2017 | Wittrup | |
| 9,932,380 B2 | 4/2018 | Gavin et al. | |
| 10,035,836 B1 | 7/2018 | Greve | |
| 10,086,046 B2 | 10/2018 | Paulson | |
| 10,093,711 B2 | 10/2018 | Kannan | |
| 10,174,091 B1 | 1/2019 | Higginson-Scott | |
| 10,174,092 B1 | 1/2019 | Higginson-Scott | |
| 10,184,009 B2 | 1/2019 | Ast | |
| 10,293,028 B2 | 5/2019 | Klatzmann | |
| 10,316,104 B2 | 6/2019 | Ast | |
| 10,323,098 B2 | 6/2019 | Ast | |
| 10,407,481 B2 | 9/2019 | Alvarez | |
| 10,562,949 B2 | 2/2020 | Hosse | |
| 10,562,950 B2 | 2/2020 | Kannan | |
| 10,676,516 B2 | 6/2020 | Viney | |
| 10,765,723 B2 | 9/2020 | Klatzmann | |
| 10,829,535 B2 | 11/2020 | Gavin | |
| 10,851,144 B2 | 12/2020 | Butz | |
| 10,927,158 B2 | 2/2021 | Seidel | |
| 10,946,068 B2 | 3/2021 | Higginson-Scott | |
| 11,098,099 B2 | 8/2021 | Klein | |
| 11,117,945 B2 | 9/2021 | Seidel | |
| 11,130,822 B2 | 9/2021 | Ast | |
| 11,319,355 B2 | 5/2022 | Bernett | |
| 11,401,314 B2 | 8/2022 | Seidel, III et al. | |
| 2003/0195154 A1 | 10/2003 | Walker et al. | |
| 2005/0142106 A1 | 6/2005 | Wittrup et al. | |
| 2006/0160187 A1 | 7/2006 | Denis-Mize et al. | |
| 2006/0234205 A1 | 10/2006 | Cao et al. | |
| 2011/0150826 A1 | 6/2011 | Paulsen et al. | |
| 2014/0286898 A1 | 9/2014 | Gavin et al. | |
| 2017/0081382 A1 | 3/2017 | Kannan | |
| 2017/0313753 A1 | 11/2017 | Gavin et al. | |
| 2018/0125941 A1 | 5/2018 | Greve | |

(Continued)

FOREIGN PATENT DOCUMENTS

| | | |
|---|---|---|
| CA | 2982362 A1 | 10/2016 |
| EP | 0262802 A2 | 4/1988 |

(Continued)

OTHER PUBLICATIONS

Jiang (Ed.), "Regulatory Cells and Clinical Application", Springer (2008), excerpt(pp. 17, 19, 20, 29,43, 58, 70, 77-78, 80, 94, 97, 135-136, and 261).
International Search Report and Written Opinion issued in PCT/US2020/043416, mailed Dec. 18, 2020, 17 pages.
Lan et al., "The regulatory, inflammatory, and T cell programming roles of interleukin-2 (IL-2)", Journal of Autoimmunity (2008), vol. 31, No. 1, pp. 7-12.
Wang et al., "Structure of the Quaternary Complex of Interleukin-2 with Its α, ß, and γc Receptors", Science (2005), vol. 310, No. 5751, pp. 1159-1163.
Rao et al., "High-Affinity CD25-Binding IL-2 Mutants Potently Stimulate Persistent T Cell Growth", Biochemistry (2005), vol. 44, No. 31, pp. 10696-10701.

(Continued)

*Primary Examiner* — Prema M Mertz
(74) *Attorney, Agent, or Firm* — Proskauer Rose LLP; Fangli Chen; Sang-Ah Kim

(57) ABSTRACT

IL-2 agents that comprise IL-2 variants are disclosed as well as methods, compositions, and uses thereof. The IL-2 agents described herein can be used to treat and/or prevent various disorders and conditions.

23 Claims, 39 Drawing Sheets

Specification includes a Sequence Listing.

(56) References Cited

U.S. PATENT DOCUMENTS

| | | |
|---|---|---|
| 2018/0340014 A1 | 11/2018 | Viney et al. |
| 2019/0077881 A1 | 3/2019 | Ast et al. |
| 2019/0169254 A1 | 6/2019 | Higginson-Scott et al. |
| 2019/0241638 A1 | 8/2019 | Bernett et al. |
| 2019/0322765 A1 | 10/2019 | Ast et al. |
| 2019/0352363 A1 | 11/2019 | Seidel, III et al. |
| 2019/0375812 A1 | 12/2019 | Greve |
| 2020/0040053 A1 | 2/2020 | Alvarez |
| 2020/0172591 A1 | 6/2020 | Hosse et al. |
| 2020/0325201 A1 | 10/2020 | Higginson-Scott et al. |
| 2021/0024601 A1 | 1/2021 | Carlson et al. |
| 2021/0038691 A1 | 2/2021 | Klatzmann et al. |
| 2021/0047382 A1 | 2/2021 | Greve |
| 2021/0070828 A1 | 3/2021 | Greve |
| 2021/0094996 A1 | 4/2021 | Viney et al. |
| 2021/0094997 A1 | 4/2021 | Gavin et al. |
| 2021/0107962 A1 | 4/2021 | Seidel, III et al. |
| 2021/0139554 A1 | 5/2021 | Butz et al. |
| 2021/0277085 A1 | 9/2021 | Higginson-Scott et al. |
| 2022/0033456 A1 | 2/2022 | Seidel, III et al. |
| 2022/0177535 A1 | 6/2022 | Carlson et al. |
| 2022/0226441 A1 | 7/2022 | Carlson et al. |
| 2022/0226442 A1 | 7/2022 | Carlson et al. |
| 2023/0390360 A1 | 12/2023 | Schachter et al. |

FOREIGN PATENT DOCUMENTS

| | | |
|---|---|---|
| EP | 0573551 B1 | 5/2003 |
| EP | 2673294 B1 | 4/2016 |
| EP | 2640411 B1 | 12/2017 |
| EP | 3280725 A2 | 2/2018 |
| EP | 2859015 B1 | 3/2018 |
| EP | 2882458 B1 | 7/2018 |
| EP | 2683395 B1 | 8/2018 |
| EP | 3075745 B1 | 9/2018 |
| EP | 2702074 B1 | 11/2018 |
| EP | 3102595 B1 | 11/2018 |
| EP | 3180020 B1 | 12/2018 |
| EP | 2970441 B1 | 3/2019 |
| EP | 2970423 B1 | 4/2019 |
| EP | 3489255 A1 | 5/2019 |
| EP | 3587444 A1 | 1/2020 |
| EP | 3630163 A1 | 4/2020 |
| EP | 3443979 B1 | 5/2020 |
| EP | 3482766 B1 | 5/2020 |
| EP | 2382228 B1 | 8/2020 |
| EP | 3766513 A1 | 1/2021 |
| JP | 5651583 B2 | 1/2015 |
| JP | 5766124 B2 | 8/2015 |
| JP | 5878182 B2 | 3/2016 |
| JP | 5972355 B2 | 8/2016 |
| JP | 6054889 B2 | 12/2016 |
| JP | 6155300 B2 | 6/2017 |
| JP | 6306201 B2 | 4/2018 |
| JP | 6416855 B2 | 10/2018 |
| JP | 6450365 B2 | 1/2019 |
| JP | 6480409 B2 | 3/2019 |
| JP | 6526561 B2 | 6/2019 |
| JP | 6559607 B2 | 8/2019 |
| JP | 6640834 B2 | 2/2020 |
| JP | 2020511949 A | 4/2020 |
| JP | 6768633 B2 | 10/2020 |
| JP | 2021006038 A | 1/2021 |
| SG | 11201708349 A | 11/2017 |
| WO | 1988/009344 A1 | 12/1988 |
| WO | 1992/015682 A1 | 9/1992 |
| WO | 93/20849 A1 | 10/1993 |
| WO | 1995/011922 A1 | 5/1995 |
| WO | 99/60128 A1 | 11/1999 |
| WO | 2003/015697 A2 | 2/2003 |
| WO | 2005007121 A2 | 1/2005 |
| WO | 2005086751 A2 | 9/2005 |
| WO | 2005086798 A2 | 9/2005 |
| WO | 2008/003473 A2 | 1/2008 |
| WO | 2009/061853 A2 | 5/2009 |
| WO | 2009135615 A2 | 11/2009 |
| WO | 2010/021519 A2 | 2/2010 |
| WO | 2010/021520 A2 | 2/2010 |
| WO | 2010/021521 A2 | 2/2010 |
| WO | 2010/021522 A2 | 2/2010 |
| WO | 2010/021523 A2 | 2/2010 |
| WO | 2010/021524 A2 | 2/2010 |
| WO | 2010/021525 A2 | 2/2010 |
| WO | 2010/021526 A2 | 2/2010 |
| WO | 2010/021527 A2 | 2/2010 |
| WO | 2010/085495 A1 | 7/2010 |
| WO | 2010085495 A1 | 7/2010 |
| WO | 2012065212 A1 | 5/2012 |
| WO | 2012107417 A1 | 8/2012 |
| WO | 2012123381 A1 | 9/2012 |
| WO | 2012146628 A1 | 11/2012 |
| WO | 2013177187 A2 | 11/2013 |
| WO | 2013184938 A2 | 12/2013 |
| WO | 2013184939 A2 | 12/2013 |
| WO | 2013184942 A1 | 12/2013 |
| WO | 2014023752 A1 | 2/2014 |
| WO | 2014153063 A1 | 9/2014 |
| WO | 2014153111 A2 | 9/2014 |
| WO | 2015118016 A1 | 8/2015 |
| WO | 2016014428 A2 | 1/2016 |
| WO | 2016025385 A1 | 2/2016 |
| WO | 2016164937 A2 | 10/2016 |
| WO | 2017/014679 A2 | 1/2017 |
| WO | 2016164937 A9 | 5/2018 |
| WO | 2018089420 A1 | 5/2018 |
| WO | 2018119114 A1 | 6/2018 |
| WO | 2018217989 A1 | 11/2018 |
| WO | 2019010224 A1 | 1/2019 |
| WO | 2019/070726 A1 | 4/2019 |
| WO | 2019112852 A1 | 6/2019 |
| WO | 2019112854 A1 | 6/2019 |
| WO | 2019125732 A1 | 6/2019 |
| WO | 2020/020783 A1 | 1/2020 |
| WO | 2021021606 A1 | 2/2021 |
| WO | 2022/120224 A1 | 6/2022 |
| WO | 2022/159590 A1 | 7/2022 |
| WO | 2023102463 A1 | 6/2023 |
| WO | 2023154870 A1 | 8/2023 |

OTHER PUBLICATIONS

Fujii et al., "Activation of Stat5 by interleukin 2 requires a carboxyl-terminal region of the interleukin 2 receptor beta chain but is not essential for the proliferative signal transmission," PNAS (1995), vol. 92, pp. 5482 5486.

Hoyer et al., "Interleukin-2 in the development and control of inflammatory disease", Immunological Reviews (2008), vol. 226, pp. 19-28.

Liston et al., "Tracing the action of IL-2 in tolerance to islet-specific antigen", Immunology and Cell Biology (2007), vol. 85, pp. 338-342.

Passerini et al.2008, "STAT5-signaling cytokines regulate the expression of FOXP3 in CD41CD251 regulatory T cells and CD41CD252 effector T cells", International Immunology (2008), vol. 20, No. 3, pp. 421-431.

Adeegbe et al., "Cutting Edge: Allogeneic CD4+CD25+Foxp3+ T Regulatory Cells Suppress Autoimmunity while Establishing Transplantation Tolerance", J. Immunol. (2006), vol. 176, pp. 7149-7153.

Cassell et al., "Therapeutic Enhancement of IL-2 Through Molecular Design", Current Pharmaceutical Design (2002), vol. 8, pp. 2171-2183.

Brusko et al., "Human regulatory T cells: role in autoimmune disease and therapeutic opportunities" Immunological Reviews (2008), vol. 223, pp. 371-390.

Shanafelt et al., "A T-cell selective interleukin 2 mutein exhibits potent antitumor activity and is well tolerated in vivo," Nat Biotechnol (2000), vol. 18, pp. 1197-1202.

Boyman et al., "Potential use of IL-2/anti-IL-2 antibody immune complexes for the treatment of cancer and autoimmune disease", Expert Opin. Biol. Ther. (2006), vol. 6, No. 12, pp. 1325-1331.

(56) References Cited

OTHER PUBLICATIONS

"Webster et al., ""In vivo expansion of T reg cells with IL-2-mAb complexes: induction of resistance to EAE and long-term acceptance of islet allografts without immunosuppression"", J. Exp. Med. (2009), vol. 206, No. 4, pp. 751-760".
"Liu et al. ""Engineered Interleukin-2 Antagonists for the Inhibition of Regulatory T cells"", J. Immunother. (2009), vol. 32, No. 9, pp. 887-894".
Heaton et al., "Characterization of Lymphokine-Activated Killing by Human Peripheral Blood Mononuclear Cells Stimulated with Interleukin 2 (IL-2) Analogs Specific for the Intermediate Affinity IL-2 Receptor", Cellular Immunology (1993), vol. 147, No. 1, pp. 167-179.
Malek et al., "Tolerance, not immunity, crucially depends on IL-2", Nature Reviews Immunology (2004), vol. 4, pp. 665-674.
Bensinger et al., "Distinct IL-2 Receptor Signaling Pattern in CD4+CD25+ Regulatory T Cells", J Immunol (2009), vol. 172, No. 9, pp. 5287-5296.
Ahmadzadeh et al., "IL-2 administration increases CD4 CD25hi Foxp3 regulatory T cells in cancer patients", Blood (2006), vol. 107, No. 6, pp. 2409-2414.
Imamichi et al, "IL-15 acts as a potent inducer of CD4+CD25hi cells expressing FOXP3", Eur. J. Immunol (2008), vol. 38, No. 6, pp. 1621-1630.
Valencia and Lipsky, "CD4+CD25+FoxP3+ regulatory T cells in autoimmune diseases", Nature Reviews Rheumatology (2007), vol. 3, pp. 619-626.
Malek, "The Biology of Interleukin-2", Annual Review of Immunology (2008), vol. 26, pp. 453-479.
Pandiyan et al., "CD4+CD25+Foxp3+ regulatory T cells induce cytokine deprivation-mediated apoptosis of effector CD4+ T cells", Nature Immunology (2007), vol. 8, pp. 1353-1362.
Letourneau et al., "IL-2- and CD25-dependent immunoregulatory mechanisms in the homeostasis of T-cell subsets", Journal of Allergy and Clinical Immunology (2009), vol. 123, No. 4, pp. 758-762.
Eisenstein and Williams, "The Treg/Th17 Cell Balance: A New Paradigm for Autoimmunity", Pediatr Res. (2009), vol. 65, No. 2, pp. 26R-31R.
Sakaguchi et al., "Regulatory T Cells and Immune Tolerance", Cell "2008", vol. 133, No. 5, pp. 775-787.
Jiang (Ed.): Regulatory Cells and Clinical Application, D7 Springer2008, excerpt(pp. 17, 19, 20, 29,43, 58, 70, 77-78, 80, 94, 97, 135-136, and 261).
Chen and Hershey, "Signal transducer and activator of transcription signals in allergic disease", Journal of Allergy and Clinical Immunology (2007), vol. 119, No. 3, pp. 529-541.
Zorn et al., "IL-2 regulates FOXP3 expression in human CD4 CD25 regulatory T cells through a STAT-dependent mechanism and induces the expansion of these cells in vivo", Blood (2006), vol. 108, No. 5, pp. 1571-1579.
Tang et al., "Central Role of Defective Interleukin-2 Production in the Triggering of Islet Autoimmune Destruction", Immunity (2008), vol. 28, No. 5, pp. 687-697.
Humrich et al., "Homeostatic imbalance of regulatory and effector T cells due to IL-2 depirvation amplifies murine upus", Proc Natl Acad Sci USA (2010), vol. 107, No. 1, pp. 204-209.
Goodson and Katre, "Site-Directed Pegylation of Recombinant Interleukin-2 at its Glycosylation Site", Nature Biotechnology (1990), vol. 8, pp. 343-346.
Adams et al., "Targeting cytokines to inflammation sites", Nature Biotechnology (2003), vol. 21, pp. 1314-1320.
Allan et al., "Activation-induced FOXP3 in human T effector cells does not suppress proliferation or cytokine production", International Immunoloav (2007), vol. 19, No. 4, pp. 345-354.
Leipe et al., "Regulatory T cells in rheumatoid arthritis", Arthritis Res Ther. (2005), vol. 7, No. 3, pp. 93-99.
Tran et al., "Induction of FOXP3 expression in naive human CD4 FOXP3 T cells by T-cell receptor stimulation is transforming growth factor—dependent but does not confer a regulatory phenotype", Blood (2007), vol. 110, No. 8, pp. 2983-2990.
Shevach", "Mechanisms of Foxp3+ T Regulatory Cell-Mediated Suppression", Immunity (2009), vol. 30, No. 5, pp. 636-645.
Jazayeri & Carroll, "Fc-Based Cytokines", BioDrugs (2008), vol. 22, pp. 11-26.
Rao et al., "Interleukin-2 mutants with enhanced alpha-receptor subunit binding affinity", Protein Eng. (2003), vol. 16, No. 12, pp. 1081-1087.
Koreth et al., "Interleukin-2 and regulatory T cells in graft-versus-host disease", N Engl J Med. (2011), vol. 365, No. 22, pp 2055-66.
Liu et al., " Fc Engineering for Developing Therapeutic Bispecific Antibodies and Novel Scaffolds", Front Immunol. (2017), vol. 8, pp. 38.
Peterson et al., "A long-lived IL-2 mutein that selectively activates and expands regulatory T cells as a therapy for autoimmune disease", J Autoimmun. (2018) , vol. 95, pp. 1-14.
Stauber et al., "Crystal structure of the IL-2 signaling complex: paradigm for a heterotrimeric cytokine receptor", Proc Natl Acad Sci USA (2006), vol. 103, No. 8, pp. 2788-2793.
Carmenate et al., "Human IL-2 mutein with higher antitumor efficacy than wild type IL-2", J Immunol. (2013), vol. 190, No. 12, pp. 6230-6238.
Rojas et al., "Directed evolution of super-secreted variants from phage-displayed human Interleukin-2", Sci Rep. (2019), vol. 9, No. 1, pp. 800.
Zhao et al., "Increasing the homogeneity, stability and activity of human serum albumin and interferon-α2b fusion protein by linker engineering", Protein Expression and Purification (2008), vol. 61, No. 1, pp. 73-77.
Arai et al., "Design of the linkers which effectively separate domains of a bifunctional fusion protein", Protein Eng. (2001), vol. 14, No. 8, pp. 529-532.
Bell et al., "Sustained in vivo signaling by long-lived IL-2 induces prolonged increases of regulatory T cells", .J Autoimmun. (2015), vol. 56, pp. 66-80.
International Search Report and Written Opinion in International Patent Application No. PCT/US2021/061883 dated Apr. 7, 2022.
International Search Report and Written Opinion in International Patent Application No. PCT/US2022/013141 dated Jun. 3, 2022.
Pilat, N. et al. "Treg-mediated prolonged survival of skin allografts without immunosuppression," Proceedings of the National Academy of Sciences—PNAS, vol. 116, No. 27 (2019) pp. 13508-13516.
Bachmann, M. F. & Oxenius, A. "Interleukin 2: from immunostimulation to immunoregulation and back again," EMBO Reports, vol. 8, No. 12 (2007) pp. 1142-1148.
Sun et al., "A Novel Anti-Human Syndecan-1(CD138) Monoclonal Antibody 4B3: Characterization and Application," Cellular & Molecular Immunology (2007) vol. 4, No. 3, pp. 209-214.
Yu, T et al. "An Immune Based, Anti-CD138 Targeting Antibody for the Treatment of Multiple Myeloma," Blood—American Society of Hematology, (2018) vol. 132 (Supplement 1), pp. 1-3.
Argos, P. "An investigation of oligopeptides linking domains in protein tertiary structures and possible candidates for general gene fusion," Journal of Molecular Biology, vol. 211, No. 4 (1990) pp. 943-958.
Huston, J. S. et al. "Protein engineering of antibody binding sites: recovery of specific activity in an anti-digoxin single-chain Fv analogue produced in *Escherichia coli*," Proceedings of the National Academy of Sciences of the United States of America, vol. 85, No. 16 (1988) pp. 5879-5883.
Farhat, A. M. et al. "Modeling cell-specific dynamics and regulation of the common gamma chain cytokines," Cell Reports, vol. 35, No. 4 (2021): 109044.
International Search Report and Written Opinion in International Patent Application No. PCT/US2022/080728 dated Mar. 22, 2023.
International Search Report and Written Opinion in International Patent Application No. PCT/US2023/062395 dated May 26, 2023.
Ram, R. & Storb, R. "Pharmacologic prophylaxis regimens for acute GVHD—past, present and future." Leukemia & Lymphoma vol. 54,8 (2013): 1591-1601.
UVA Health, "Transplant Rejection", https://uvahealth.com/services/transplant/transplant-rejection, 2023.

(56) References Cited

OTHER PUBLICATIONS

Wood, K. J. "Regulatory T cells in transplantation." Transplantation Proceedings vol. 43,6 (2011): 2135-2136.
Zeiser et al., "Differential impact of mammalian target of rapamycin inhibition on CD4 CD25 Foxp3 regulatory T cells compared with conventional CD4 T cells", Blood (2008), vol. 11, No. 1, p. 453-462.
Zheng, X. X. et al. "The balance of deletion and regulation in allograft tolerance." Immunological Reviews vol. 196 (2003): 75-84.

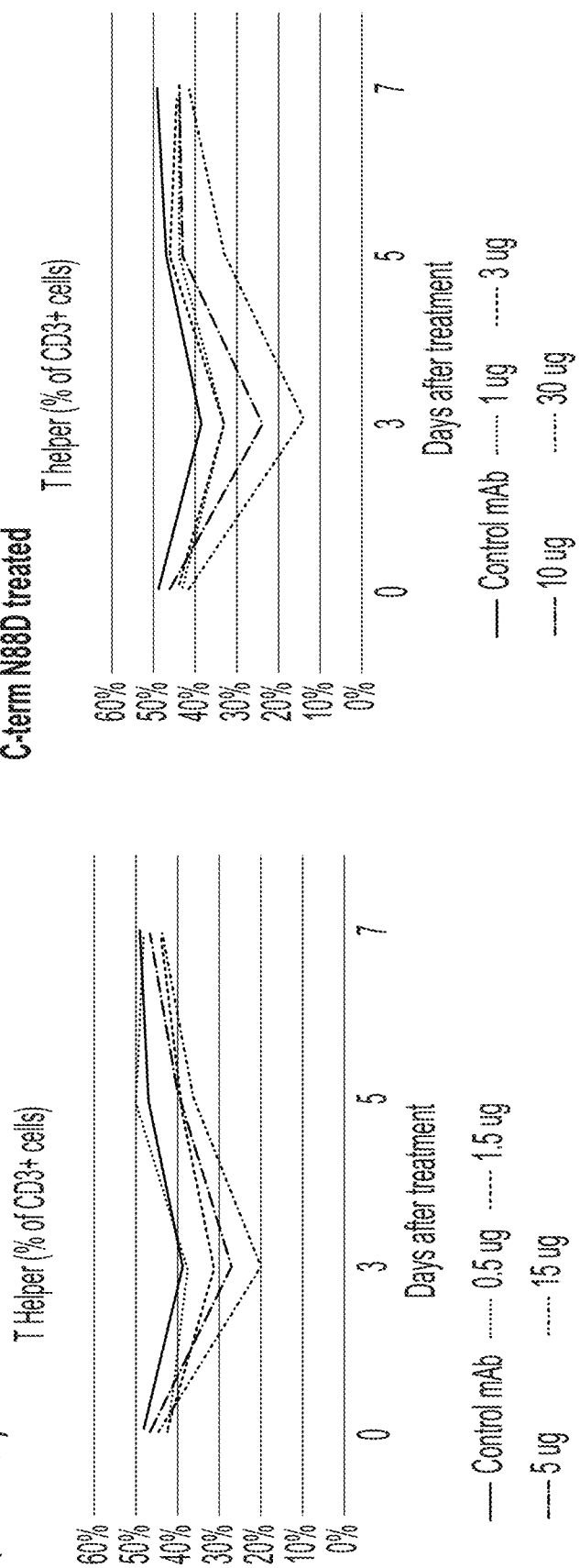

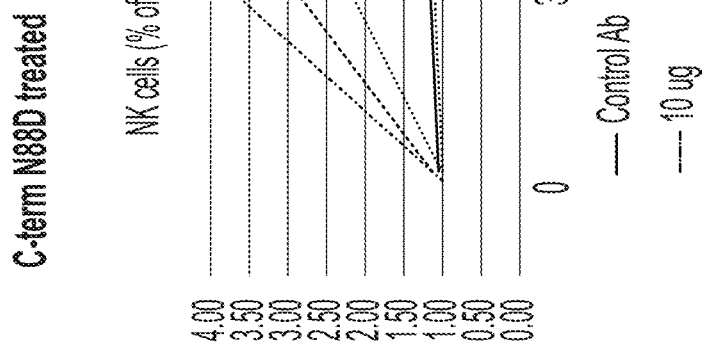
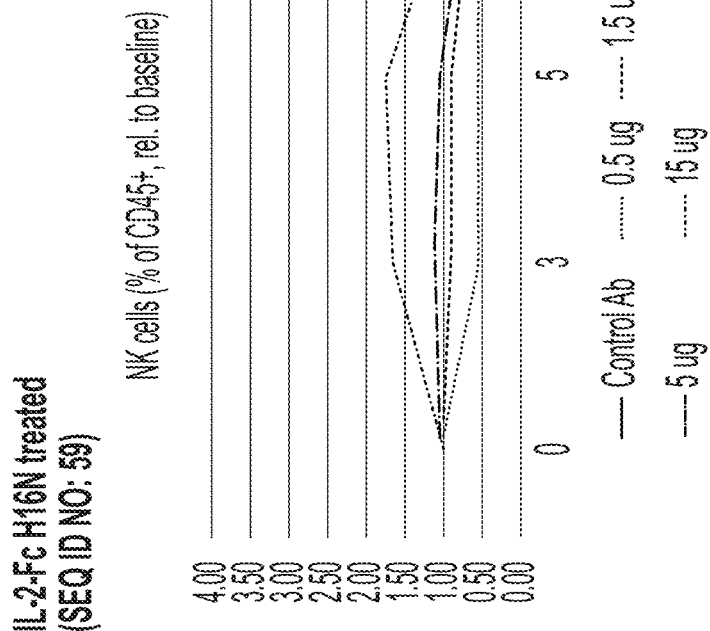
FIG. 15B
FIG. 15A

US 12,084,484 B2

INTERLEUKIN-2 AGENTS AND USES THEREOF

CROSS REFERENCE TO RELATED APPLICATIONS

This application claims the benefit of U.S. Provisional Application No. 62/879,137, filed on Jul. 26, 2019, and U.S. Provisional Application No. 62/983,061, filed Feb. 28, 2020. The contents of the aforementioned applications are hereby incorporated by reference in their entirety.

SEQUENCE LISTING

The instant application contains a Sequence Listing which has been submitted electronically in ASCII format and is hereby incorporated by reference in its entirety. Said ASCII copy, created on Jul. 20, 2020, is named P2029-702810_SL.txt and is 1,711,732 bytes in size.

INCORPORATION BY REFERENCE OF LARGE TABLES

The instant application contains two Large Tables: Table 9 and Table 10, which have been submitted by read-only optical disc in ASCII format and are hereby incorporated by reference in their entireties. Said ASCII copies, created on Apr. 24, 2024, are named SVI-006US1_Table_9.txt and SVI-006US1_Table_10.txt and are 142,591 bytes and 394,804 bytes in size, respectively.

BACKGROUND

Interleukin-2 (IL-2) is a cytokine that regulates the activities of the immune system. It is produced by leukocytes, such as T cells, natural killer (NK) cells, dendritic cells, and macrophages, in response to antigenic or mitogenic stimulation. IL-2 is important for T cell proliferation, B cell stimulation, and other activities associated with immunity and tolerance. It is part of the body's adaptive immune response and discriminates between foreign and host antigens. IL-2 mediates its effects by binding to IL-2 receptors, which in turn activate downstream signaling events.

Human IL-2 is an-FDA approved drug for the treatment of diseases such as metastatic renal carcinoma and melanoma. The use of IL-2 in eligible patients is sometimes restricted due to the severe toxicity associated with IL-2 therapy, and only a small subset of eligible patients will actually receive therapy. The toxicities associated with IL-2 therapy can include severe fever, nausea, vomiting, vascular leak and serious hypotension. Despite these toxicities, however, IL-2 is typically effective for its approved indications.

For patients with various diseases and conditions that are amenable to treatment with IL-2, there continues to be an unmet need for novel IL-2-based agents that exhibit characteristics sufficient for the development of a safe and efficacious therapeutic.

SUMMARY

This disclosure provides, at least in part, IL-2 agents (e.g., IL-2 variants, IL-2 fusion proteins, IL-2 complexes, and IL-2 conjugates) that comprise one or more amino acid alterations (e.g., substitutions) in IL-2, and that comprise one or more of the structural or functional properties disclosed herein. In an embodiment, nucleic acid molecules encoding the IL-2 agents, expression vectors, host cells, compositions (e.g., pharmaceutical compositions), kits, containers, and methods for making the IL-2 agents, are also provided. The IL-2 agents disclosed herein can be used (alone or in combination with other agents or therapeutic modalities) to treat, prevent, and/or diagnose disorders, such as disorders and conditions disclosed herein.

The present disclosure is based, at least in part, on the discovery that a combination of mutations in IL-2 that stabilize the protein, reduce its affinity for CD122 (e.g., CD122/CD132 heterodimer), and/or reduce or have no more than a minimal effect on its affinity for CD25, can be used to selectively enhance regulatory T cell (Treg) activity through the IL-2 pathway, and therefore achieve advantageous therapeutic effects for treating disorders and conditions such as autoimmune diseases. IL-2 agents comprising such mutations are suitable for treating conditions arising from abnormal immune responses, such as autoimmune diseases.

Accordingly, in certain aspects, this disclosure provides an IL-2 agent, e.g., an IL-2 agent having one or more (e.g., 1, 2, 3, 4, 5, 6, 7, 8, 9, 10, 11, 12, 13, 14, 15, 16, 17, 18, 19, 20, 21, 22, 23, or all) of the following properties a)-x):

a) Expresses at a higher or increased level in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more, or by increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more, e.g., relative to an IL-2 agent comprising a wild-type IL-2 or an IL-2 agent comprising a reference IL-2 variant, e.g., as by an assay of protein concentration;

b) Aggregates at lower or decreased level in vitro and/or in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more, or decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more e.g., relative to an IL-2 agent comprising a wild-type IL-2 or an IL-2 agent comprising a reference IL-2 variant, e.g., as determined by melting temperature analysis (e.g., using fluorimetry), dynamic light scattering, and/or size-exclusion chromatography;

c) Has enhanced or increased stability in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more, or increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more, e.g., relative to an IL-2 agent comprising a wild-type IL-2 or an IL-2 agent comprising a reference IL-2 variant, e.g., as determined by expression in yeast surface display, expression in mammalian cells, chromatography, circular dichroism or related spectroscopic technical, and/or melting temperature analysis (e.g., using fluorimetry);

d) Has enhanced or increased half-life in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more, or greater than about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more, e.g., relative to an IL-2 agent comprising a wild-type IL-2 or an IL-2 agent comprising a reference IL-2 variant, e.g., as determined by ELISA, flow cytometry, and/or mass spectrometry;

e) Has a lower, reduced or decreased rate or level of turnover and/or clearance in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more, or decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more, e.g., relative to an IL-2 agent comprising a wild-type IL-2 or an IL-2 agent comprising a reference IL-2 variant, e.g., as determined by ELISA, flow cytometry, and/or mass spectrometry;

f) Has reduced or decreased or substantially unchanged binding affinity for CD25 (e.g., human CD25), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more (e.g., about 1% to about 20%, about 2% to about 15%, or about 5% to about 10%), or decreased or increased by no more than about 1%, about 2%, about 3%, about 4%, about 5%, about 10%, about 15%, about 20%, about 25%, about 30%, about 35%, about 40%, about 45%, or about 50%, or decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more, or decreased or increased by no more than about 0.5-fold, about 1-fold, about 1.5-fold, about 2-fold, about 2.5-fold, about 3-fold, about 3.5-fold, about 4-fold, about 4.5-fold, or about 5-fold, e.g., relative to an IL-2 agent comprising a wild-type IL-2 or an IL-2 agent comprising a reference IL-2 variant e.g., as determined by yeast surface display, bio-layer interferometry (e.g. Octet binding), and/or surface plasmon resonance (e.g. Biacore);

g) Binds to CD25 (e.g., human CD25) with low affinity, e.g., with a dissociation constant ($K_D$) of about 5-500 pM, e.g., about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, or e.g., about 10 pM to about 490 pM, about 20 pM to about 480 pM, about 30 pM to about 470 pM, about 40 pM to about 460 pM, about 50 pM to about 450 pM, about 60 pM to about 440 pM, about 70 pM to about 430 pM, about 80 pM to about 420 pM, about 90 pM to about 410 pM, about 100 pM to about 400 pM, about 110 pM to about 390 pM, about 120 pM to about 380 pM, about 130 pM to about 370 pM, about 140 pM to about 360 pM, about 150 pM to about 350 pM, about 160 pM to about 340 pM, about 170 pM to about 330 pM, about 180 pM to about 320 pM, about 190 pM to about 310 pM, about 200 pM to about 300 pM, about 210 pM to about 290 pM, about 220 pM to about 280 pM, about 230 pM to about 270 pM, about 240 pM to about 260 pM, or e.g., about 5 pM to about 450 pM, about 5 pM to about 400 pM, about 5 pM to about 350 pM, about 5 pM to about 300 pM, about 5 pM to about 250 pM, about 5 pM to about 200 pM, about 5 pM to about 150 pM, about 5 pM to about 100 pM, about 5 pM to about 50 pM, or e.g., about 10 pM to about 500 pM, about 20 pM to about 500 pM, about 50 pM to about 500 pM, about 100 pM to about 500 pM, about 150 pM to about 500 pM, about 200 pM to about 500 pM, about 250 pM to about 500 pM, about 300 pM to about 500 pM, about 350 pM to about 500 pM, about 400 pM to about 500 pM, about 450 pM to about 500 pM, or e.g., greater than about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, e.g. as determined yeast surface display;

h) Binds to CD25 (e.g., human CD25) with low affinity, e.g., with a dissociation constant ($K_D$) of about 0.1-10 nM, e.g., about 0.1, about 0.2, about 0.3, about 0.4, about 0.5, about 0.6, about 0.7, about 0.8, about 0.9, about 1, about 1.5, about 2, about 2.5, about 3, about 3.5, about 4, about 4.5, about 5, about 6, about 7, about 8, about 9, or about 10 nM, or e.g., about 0.1 to about 9 nM, about 0.1 to about 8 nM, about 0.1 to about 7 nM, or about 0.1 to about 6 nM, e.g., about 0.1 to about 5 nM, about 0.1 to about 4 nM, about 0.1 to about 3 nM, about 0.1 to about 2 nM, about 0.1 to about 1 nM, or about 0.1 to about 0.5 nM, or e.g., about 0.1 to about 10 nM, about 0.5 to about 10 nM, about 1 to about 10 nM, about 1.5 to about 10 nM, about 2 to about 10 nM, about 2.5 to about 10 nM, about 3 to about 10 nM, about 3.5 to about 10 nM, about 4 to about 10 nM, about 4.5 to about 10 nM, about 5 to about 10 nM, about 5.5 to about 10 nM, about 6 to about 10 nM, about 6.5 to about 10 nM, about 7 to about 10 nM, about 7.5 to about 10 nM, about 8 to about 10 nM, about 8.5 to about 10 nM, about 9 to about 10 nM, or about 9.5 to about 10 nM, or e.g., about 0.1 to about 9.5 nM, about 0.5 to about 9 nM, about 1 to about 8.5 nM, about 1.5 to about 8 nM, about 2 to about 7.5 nM, about 2.5 to about 7 nM, about 3 to about 6.5 nM, about 3.5 to about 6 nM, about 4 to about 5.5 nM, or about 4.5 to about 5 nM, or e.g., greater than about 0.1, about 0.2. about 0.3, about 0.4, about 0.5, about 0.6, about 0.7, about 0.8, about 0.9, about 1, about 2, about 3, about 4, about 5, about 6, about 7, about 8, about 9, or about 10 nM, e.g., as determined by bio-layer interferometry (e.g., Octet binding) and/or surface plasmon resonance (e.g. Biacore);

i) Has reduced or decreased binding affinity for CD122/CD132 heterodimer (e.g., human CD122/CD132 heterodimer), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more (e.g., about 1% to about 50%, about 2% to about 40%, about 3% to about 30%, about 4% to about 20%, or about 5% to about 10%, about 1% to about 40%, about 1% to about 30%, about 1% to about 20%, about 1% to about 10%, about 40% to about 50%, about 30% to about 50%, about 20% to about 50%, about 10% to about 50%, about 10% to about 20%, about 20% to about 30%, about 30% to about 40%, about 10% to about 30%, or 20% to about 40%), or decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more (e.g., about 0.5-fold to about 5-fold, about 1-fold to about 4-fold, or about 2-fold to about 3-fold), e.g., relative to an IL-2 agent comprising a wild-type IL-2 or an IL-2 agent comprising a reference IL-2 variant e.g., as determined by yeast surface display, bio-layer interferometry (e.g. Octet binding), and/or surface plasmon resonance (e.g. Biacore);

j) Binds to CD122/CD132 heterodimer (e.g., human CD122/CD132 heterodimer) with low affinity, e.g., with a dissociation constant ($K_D$) of about 0.2-20 nM, e.g., about 0.2, about 0.3, about 0.4, about 0.5, about 0.6, about 0.7, about 0.8, about 0.9, about 1, about 1.1, about 1.2, about 1.3, about 1.4. about 1.5, about 2, about 3, about 4, about 5, about 6, about 7, about 8, about 9, about 10, about 11, about 12, about 13, about 14, about 15, about 16, about 17, about 18, or about 20 nM, or e.g., about 0.2 to about 19 nM, about 0.2 to about 18 nM, about 0.2 to about 17 nM, or about 0.2 to about 16 nM, e.g., about 0.2 to about 15 nM, about 0.1 to about 4 nM, about 0.1 to about 3 nM, about 0.1 to about 2 nM, about 0.1 to about 1 nM, or about 0.1 to about 0.5 nM, or e.g., about 0.1 to about 10 nM, about 0.5 to about 10 nM, about 1 to about 10 nM, about 1.5 to about 10 nM, about 2 to about 10 nM, about 2.5 to about 10 nM, about 3 to about 10 nM, about 3.5 to about 10 nM, about 4 to about 10 nM, about 4.5 to about 10 nM, about 5 to about 10 nM, about 5.5 to about 10 nM, about 6 to about 10 nM, about 6.5 to about 10 nM, about 7 to about 10 nM, about 7.5 to about 10 nM, about 8 to about 10 nM, about 8.5 to about 10 nM, about 9 to about 10 nM, or about 9.5 to about 10 nM, or e.g., about 0.1 to about 9.5 nM, about 0.5 to about 9 nM, about 1 to about 8.5 nM, about 1.5 to about 8 nM, about 2 to about 7.5 nM, about 2.5 to about 7 nM, about 3 to about 6.5 nM, about 3.5 to about 6 nM, about 4 to about 5.5 nM, or about 4.5 to about 5 nM, or e.g., greater than about 0.2, about 0.3, about 0.4, about 0.5, about 0.6, about 0.7, about 0.8, about 0.9, about 1, about 1.1, about 1.2, about 1.3, about 1.4. about 1.5, about 2, about 3, about 4, about 5, about 6, about 7, about 8, about 9, about 10, about 11, about 12, about 13, about 14, about 15, about 16, about 17, about 18, or about 20 nM, e.g., as determined by yeast surface display.

k) Binds to CD122/CD132 heterodimer (e.g., human CD122/CD132 heterodimer) with low affinity, e.g., with a dissociation constant ($K_D$) of about 0.2-300 nM, e.g., about 0.2 nM, about 0.5 nM, about 1 nM, about 2 nM, about 5 nM, about 10 nM, about 15 nM, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about 190 nM, about 200 nM, about 210 nM, about 220 nM, about 230 nM, about 240 nM, about 250 nM, about 260 nM, about 270 nM, about 280 nM, about 290 nM, or about 300 nM, or e.g., About 0.2 to about 280 nM, about 0.2 to about 260 nM, about 0.2 to about 240 nM, about 0.2 to about 220 nM, about 0.2 to about 200 nM, about 0.2 to about 180 nM, about 0.2 to about 160 nM, about 0.2 to about 140 nM, about 0.2 to about 120 nM, about 0.2 to about 100 nM, about 0.2 to about 80 nM, about 0.2 to about 60 nM, about 0.2 to about 40 nM, about 0.2 to about 20 nM, or e.g., about 0.5 to about 300 nM, about 1 to about 300 nM, about 5 to about 300 nM, about 10 to about 300 nM, about 20 to about 300 nM, about 40 to about 300 nM, about 60 to about 300 nM, about 80 to about 300 nM, about 100 to about 300 nM, about 120 to about 300 nM, about 140 to about 300 nM, about 160 to about 300 nM, about 180 to about 300 nM, about 200 to about 300 nM, about 220 to about 300 nM, about 240 to about 300 nM, about 260 to about 300 nM, about 280 to about 300 nM, or e.g., about 0.5 to about 280 nM, about 1 to about 260 nM, about 5 to about 240 nM, about 10 to about 220 nM, about 20 to about 200 nM, about 40 to about 180 nM, about 60 to about 160 nM, about 80 to about 140 mM, about 100 to about 120 nM, or e.g., greater than about 0.2, about 0.5, about 1, about 2, about 5, about 10, about 15, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about 190 nM, about 200 nM, about 210 nM, about 220 nM, about 230 nM, about 240 nM, about 250 nM, about 260 nM, about 270 nM, about 280 nM, about 290 nM, or greater than about 300 nM, e.g., as determined by biolayer interferometry (e.g. Octet binding) and/or surface plasmon resonance (e.g. Biacore);

l) Selectively activates IL-2 signaling in T regulatory cells in vitro and/or in vivo, e.g., having an T helper $EC_{50}$/Treg $EC_{50}$ ratio greater than about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 35, about 40, about 45, about 50, about 55, about 60, about 65, about 70, about 75, about 80, about 85, about 90, about 95, about 100, about 150, about 200, about 250, about 300, about 350, about 400, about 450, about 500, about 600, about 700, about 800, about 900, about 1000, about 1500, about 2000, about 2500, or about 3000, or more, or e.g., greater than 1 and about 1 to 2, about 2 to 3, about 3 to 4, about 4 to 5, greater than 1 and about 1 to 10, greater than 1 and about 1 to 20, greater than 1 and about 1 to 30, greater than 1 and about 1 to 40, greater than 1 and about 1 to 50, about 2 to 10, about 2 to 20, about 2 to 30, about 2 to 40, 2 to 50, about 5 to 10, about 5 to 20, about 5 to 30, about 5 to 40, about 5 to 50, about 10 to 20, about 10 to 30, about 10 to 40 about 10 to 50, about 20 to 40, about 20 to 50, about 50 to 100, about 100 to 200, about 200 to 500, about 500 to 1000, about 1000 to 2000, or about 1000 to 3000, relative to an IL-2 agent comprising a wild-type IL-2 or an IL-2 agent comprising a reference IL-2 variant e.g., as determined flow cytometry;

m) Selectively activates IL-2 signaling in T regulatory cells in vitro and/or in vivo, e.g., having an NK cell $EC_{50}$/Treg $EC_{50}$ ratio greater than about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 35, about 40, about 45, about 50, about 55, about 60, about 65, about 70, about 75, about 80, about 85, about 90, about 95, about 100, about 150, about 200, about 250, about 300, about 350, about 400, about 450, about 500, about 600, about 700, about 800, about 900, about 1000, about 1500, about 2000, about 2500, or about 3000, or more, or e.g., greater than 1 and about 1 to 2, about 2 to 3, about 3 to 4, about 4 to 5, greater than 1 and about 1 to 10, greater than 1 and about 1 to 20, greater than 1 and about 1 to 30, greater than 1 and about 1 to 40, greater than 1 and about 1 to 50, about 2 to 10, about 2 to 20, about 2 to 30, about 2 to 40, 2 to 50, about 5 to 10, about 5 to 20, about 5 to 30, about 5 to 40, about 5 to 50, about 10 to 20, about 10 to 30, about 10 to 40 about 10 to 50, about 20 to 40, about 20 to 50, about 50 to 100, about 100 to 200, about 200 to 500, about 500 to 1000, about 1000 to 2000, or about 1000 to 3000, relative to an IL-2 agent comprising a wild-type IL-2 or an IL-2 agent comprising a reference IL-2 variant e.g., as determined flow cytometry;

n) (i) Has enhanced or increased potency and/or ability to induce or promote T regulatory cell activity, e.g., having an $EC_{50}$ for Tregs that is lower by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant e.g., as determined flow cytometry, a T regulatory cell proliferation or expansion assay in vitro or in vivo, and/or a T cell suppression assay;

(ii) Has reduced or decreased potency and/or ability to induce or promote T regulatory cell activity, e.g., having an $EC_{50}$ for Tregs that is higher by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, about 50-fold, about 100-fold, about 200-fold, about 500-fold, about 1000-fold, about 2000-fold, about 5000-fold, about 10,000-fold, about 15,000-fold, about 20,000-fold or more e.g., relative to an IL-2 agent comprising a wild-type IL-2 or an IL-2 agent comprising a reference IL-2 variant e.g., as determined flow cytometry, a T regulatory cell proliferation or expansion assay in vitro or in vivo, and/or a T cell suppression assay;

o) Modulates (e.g., reduces (e.g., inhibits, blocks, or neutralizes) or increases (e.g., activates, initiates, or enhances) one or more biological activities of a T cell (e.g., Treg), in vitro, ex vivo, or in vivo;

p) Shows the same or similar binding affinity or specificity, or both, as an IL-2 agent described herein;

q) Shows the same or similar binding affinity or specificity, or both, as an IL-2 agent comprising one or more (e.g., 2, 3, 4, 5, 6, 7, 8, 9, 10, or more) alterations (e.g., substitutions) described herein;

r) Shows the same or similar binding affinity or specificity, or both, as an IL-2 agent comprising an amino acid sequence described herein;

s) Shows the same or similar binding affinity or specificity, or both, as an IL-2 agent comprising an amino acid sequence encoded by a nucleotide sequence described herein;

t) Inhibits, e.g., competitively inhibits, the binding of a second IL-2 agent to an IL-2 receptor, wherein the second IL-2 agent is an IL-2 agent described herein, u) Competes for binding to an IL-2 receptor with a second IL-2 agent, wherein the second IL-2 agent is an IL-2 agent described herein;

v) Has one or more biological properties of an IL-2 agent described herein;

w) Has one or more structural properties of an IL-2 agent described herein; or x) Has one or more pharmacokinetic properties of an IL-2 agent described herein.

In an embodiment, the IL-2 agent is expresses at a higher or increased level in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more, or by increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more, e.g., relative to an IL-2 agent comprising a wild-type IL-2 or an IL-2 agent comprising a reference IL-2 variant, e.g., as by an assay of protein concentration. In an embodiment, the IL2-agent aggregates at lower or decreased level in vitro and/or in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more, or decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more e.g., relative to an IL-2 agent comprising a wild-type IL-2 or an IL-2 agent comprising a reference IL-2 variant, e.g., as determined by melting temperature analysis (e.g., using fluorimetry), dynamic light scattering, and/or size-exclusion chromatography.

In an embodiment, the IL-2 agent has enhanced or increased stability in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more, or increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more, e.g., relative to an IL-2 agent comprising a wild-type IL-2 or an IL-2 agent comprising a reference IL-2 variant, e.g., as determined by expression in yeast surface display, expression in mammalian cells, chromatography, circular dichroism or related spectroscopic technical, and/or melting temperature analysis (e.g., using fluorimetry).

In an embodiment the IL-2 agent as enhanced or increased half-life in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more, or greater than about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more, e.g., relative to an IL-2 agent comprising a wild-type IL-2 or an IL-2 agent comprising a reference IL-2 variant, e.g., as determined by ELISA, flow cytometry, and/or mass spectrometry.

In an embodiment, the IL-2 agent has a lower, reduced or decreased rate or level of turnover and/or clearance in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more, or decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more, e.g., relative to an IL-2 agent comprising a wild-type IL-2 or an IL-2 agent comprising a reference IL-2 variant, e.g., as determined by ELISA, flow cytometry, and/or mass spectrometry.

In an embodiment, the IL-2 agent has reduced or decreased or substantially unchanged binding affinity for CD25 (e.g., human CD25), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more (e.g., about 1% to about 20%, about 2% to about 15%, or about 5% to about 10%), or decreased or increased by no more than about 1%, about 2%, about 3%, about 4%, about 5%, about 10%, about 15%, about 20%, about 25%, about 30%, about 35%, about 40%, about 45%, or about 50%, or decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more, or decreased or increased by no more than about 0.5-fold, about 1-fold, about 1.5-fold, about 2-fold, about 2.5-fold, about 3-fold, about 3.5-fold, about 4-fold, about 4.5-fold, or about 5-fold, e.g., relative to an IL-2 agent comprising a wild-type IL-2 or an IL-2 agent comprising a reference IL-2 variant e.g., as determined by yeast surface display, bio-layer interferometry (e.g. Octet binding), and/or surface plasmon resonance (e.g. Biacore). In an embodiment, the reduction or decrease of binding affinity for CD25 is at least 10%, 20%, 30%, 40%, 50%, 60%, 70%, or 80% lower than the reduction or decrease of binding affinity for CD25. In an embodiment, the binding affinity for CD25 is not substantially reduced or decreased.

In an embodiment, the IL-2 agent binds to CD25 (e.g., human CD25) with low affinity, e.g., with a dissociation constant (KD) of about 5-500 pM, e.g., about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, or e.g., about 10 pM to about 490 pM, about 20 pM to about 480 pM, about 30 pM to about 470 pM, about 40 pM to about 460 pM, about 50 pM to about 450 pM, about 60 pM to about 440 pM, about 70 pM to about 430 pM, about 80 pM to about 420 pM, about 90 pM to about 410 pM, about 100 pM to about 400 pM, about 110 pM to about 390 pM, about 120 pM to about 380 pM, about 130 pM to about 370 pM, about 140 pM to about 360 pM, about 150 pM to about 350 pM, about 160 pM to about 340 pM, about 170 pM to about 330 pM, about 180 pM to about 320 pM, about 190 pM to about 310 pM, about 200 pM to about 300 pM, about 210 pM to about 290 pM, about 220 pM to about 280 pM, about 230 pM to about 270 pM, about 240 pM to about 260 pM, or e.g., about 5 pM to about 450 pM, about 5 pM to about 400 pM, about 5 pM to about 350 pM, about 5 pM to about 300 pM, about 5 pM to about 250 pM, about 5 pM to about 200 pM, about 5 pM to about 150 pM, about 5 pM to about 100 pM, about 5 pM to about 50 pM, or e.g., about 10 pM to about 500 pM, about 20 pM to about 500 pM, about 50 pM to about 500 pM, about 100 pM to about 500 pM, about 150 pM to about 500 pM, about 200 pM to about 500 pM, about 250 pM to about 500 pM, about 300 pM to about 500 pM, about 350 pM to about 500 pM, about 400 pM to about 500 pM, about 450 pM to about 500 pM, or e.g., greater than about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, e.g. as determined yeast surface display.

In an embodiment, the IL-2 agent binds to CD25 (e.g., human CD25) with low affinity, e.g., with a dissociation constant (KD) of about 0.1-10 nM, e.g., about 0.1, about 0.2, about 0.3, about 0.4, about 0.5, about 0.6, about 0.7, about 0.8, about 0.9, about 1, about 1.5, about 2, about 2.5, about 3, about 3.5, about 4, about 4.5, about 5, about 6, about 7, about 8, about 9, or about 10 nM, or e.g., about 0.1 to about 9 nM, about 0.1 to about 8 nM, about 0.1 to about 7 nM, or about 0.1 to about 6 nM, e.g., about 0.1 to about 5 nM, about 0.1 to about 4 nM, about 0.1 to about 3 nM, about 0.1 to about 2 nM, about 0.1 to about 1 nM, or about 0.1 to about 0.5 nM, or e.g., about 0.1 to about 10 nM, about 0.5 to about 10 nM, about 1 to about 10 nM, about 1.5 to about 10 nM, about 2 to about 10 nM, about 2.5 to about 10 nM, about 3 to about 10 nM, about 3.5 to about 10 nM, about 4 to about 10 nM, about 4.5 to about 10 nM, about 5 to about 10 nM, about 5.5 to about 10 nM, about 6 to about 10 nM, about 6.5 to about 10 nM, about 7 to about 10 nM, about 7.5 to about 10 nM, about 8 to about 10 nM, about 8.5 to about 10 nM, about 9 to about 10 nM, or about 9.5 to about 10 nM, or e.g., about 0.1 to about 9.5 nM, about 0.5 to about 9 nM, about 1 to about 8.5 nM, about 1.5 to about 8 nM, about 2 to about 7.5 nM, about 2.5 to about 7 nM, about 3 to about 6.5 nM, about 3.5 to about 6 nM, about 4 to about 5.5 nM, or about 4.5 to about 5 nM, or e.g., greater than about 0.1, about 0.2. about 0.3, about 0.4, about 0.5, about 0.6, about 0.7, about 0.8, about 0.9, about 1, about 2, about 3, about 4, about 5, about 6, about 7, about 8, about 9, or about 10 nM, e.g., as determined by bio-layer interferometry (e.g., Octet binding) and/or surface plasmon resonance (e.g. Biacore).

In an embodiment, the IL-2 agent has reduced or decreased binding affinity for CD122/CD132 heterodimer (e.g., human CD122/CD132 heterodimer), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100%, or more (e.g., about 1% to about 50%, about 2% to about 40%, about 3% to about 30%, about 4% to about 20%, or about 5% to about 10%, about 1% to about 40%, about 1% to about 30%, about 1% to about 20%, about 1% to about 10%, about 40% to about 50%, about 30% to about 50%, about 20% to about 50%, about 10% to about 50%, about 10% to about 20%, about 20% to about 30%, about 30% to about 40%, about 10% to about 30%, or 20% to about 40%), or decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, or more (e.g., about 0.5-fold to about 5-fold, about 1-fold to about 4-fold, or about 2-fold to about 3-fold), e.g., relative to an IL-2 agent comprising a wild-type IL-2 or an IL-2 agent comprising a reference IL-2 variant e.g., as determined by yeast surface display, bio-layer interferometry (e.g. Octet binding), and/or surface plasmon resonance (e.g. Biacore). In an embodiment, the reduction or decrease of binding affinity for CD122/CD132 heterodimer is at least 1, 1.5, 2, 2.5, 3, 3.5, 4, 4.5, or 5-fold higher than the reduction or decrease of binding affinity for CD25. In an embodiment, the binding affinity for CD25 is not substantially reduced or decreased.

In an embodiment, the IL-2 agent binds to CD122/CD132 heterodimer (e.g., human CD122/CD132 heterodimer) with low affinity, e.g., with a dissociation constant (KD) of about 0.2-20 nM, e.g., about 0.2, about 0.3, about 0.4, about 0.5, about 0.6, about 0.7, about 0.8, about 0.9, about 1, about 1.1, about 1.2, about 1.3, about 1.4. about 1.5, about 2, about 3, about 4, about 5, about 6, about 7, about 8, about 9, about 10, about 11, about 12, about 13, about 14, about 15, about 16, about 17, about 18, or about 20 nM, or e.g., about 0.2 to about 19 nM, about 0.2 to about 18 nM, about 0.2 to about 17 nM, or about 0.2 to about 16 nM, e.g., about 0.2 to about 15 nM, about 0.1 to about 4 nM, about 0.1 to about 3 nM, about 0.1 to about 2 nM, about 0.1 to about 1 nM, or about 0.1 to about 0.5 nM, or e.g., about 0.1 to about 10 nM, about 0.5 to about 10 nM, about 1 to about 10 nM, about 1.5 to about 10 nM, about 2 to about 10 nM, about 2.5 to about 10 nM, about 3 to about 10 nM, about 3.5 to about 10 nM, about 4 to about 10 nM, about 4.5 to about 10 nM, about 5 to about 10 nM, about 5.5 to about 10 nM, about 6 to about 10 nM, about 6.5 to about 10 nM, about 7 to about 10 nM, about 7.5 to about 10 nM, about 8 to about 10 nM, about 8.5 to about 10 nM, about 9 to about 10 nM, or about 9.5 to about 10 nM, or e.g., about 0.1 to about 9.5 nM, about 0.5 to about 9 nM, about 1 to about 8.5 nM, about 1.5 to about 8 nM, about 2 to about 7.5 nM, about 2.5 to about 7 nM, about 3 to about 6.5 nM, about 3.5 to about 6 nM, about 4 to about 5.5 nM, or about 4.5 to about 5 nM, or e.g., greater than about 0.2, about 0.3, about 0.4, about 0.5, about 0.6, about 0.7, about 0.8, about 0.9, about 1, about 1.1, about 1.2, about 1.3, about 1.4. about 1.5, about 2, about 3, about 4, about 5, about 6, about 7, about 8, about 9, about 10, about 11, about 12, about 13, about 14, about 15, about 16, about 17, about 18, or about 20 nM, e.g., as determined by yeast surface display.

In an embodiment, the IL-2 agent binds to CD122/CD132 heterodimer (e.g., human CD122/CD132 heterodimer) with low affinity, e.g., with a dissociation constant (KD) of about 0.2-300 nM, e.g., about 0.2 nM, about 0.5 nM, about 1 nM, about 2 nM, about 5 nM, about 10 nM, about 15 nM, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about 190 nM, about 200 nM, about 210 nM, about 220 nM, about 230 nM, about 240 nM, about 250 nM, about 260 nM, about 270 nM, about 280 nM, about 290 nM, or about 300 nM, or e.g., about 0.2 to about 280 nM, about 0.2 to about 260 nM, about 0.2 to about 240 nM, about 0.2 to about 220 nM, about 0.2 to about 200 nM, about 0.2 to about 180 nM, about 0.2 to about 160 nM, about 0.2 to about 140 nM, about 0.2 to about 120 nM, about 0.2 to about 100 nM, about 0.2 to about 80 nM, about 0.2 to about 60 nM, about 0.2 to about 40 nM, about 0.2 to about 20 nM, or e.g., about 0.5 to about 300 nM, about 1 to about 300 nM, about 5 to about 300 nM, about 10 to about 300 nM, about 20 to about 300 nM, about 40 to about 300 nM, about 60 to about 300 nM, about 80 to about 300 nM, about 100 to about 300 nM, about 120 to about 300 nM, about 140 to about 300 nM, about 160 to about 300 nM, about 180 to about 300 nM, about 200 to about 300 nM, about 220 to about 300 nM, about 240 to about 300 nM, about 260 to about 300 nM, about 280 to about 300 nM, or e.g., about 0.5 to about 280 nM, about 1 to about 260 nM, about 5 to about 240 nM, about 10 to about 220 nM, about 20 to about 200 nM, about 40 to about 180 nM, about 60 to about 160 nM, about 80 to about 140 mM, about 100 to about 120 nM, or e.g., greater than about 0.2, about 0.5, about 1, about 2, about 5, about 10, about 15, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about 190 nM, about 200 nM, about 210 nM, about 220 nM, about 230 nM, about 240 nM, about 250 nM, about 260 nM, about 270 nM, about 280 nM, about 290 nM, or greater than about 300 nM, e.g., as determined by biolayer interferometry (e.g. Octet binding) and/or surface plasmon resonance (e.g. Biacore).

In an embodiment, the IL-2 agent selectively activates IL-2 signaling in T regulatory cells in vitro and/or in vivo, e.g., having an T helper EC50/Treg EC50 ratio greater than about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 35, about 40, about 45, about 50, about 55, about 60, about 65, about 70, about 75, about 80, about 85, about 90, about 95, about 100, about 150, about 200, about 250, about 300, about 350, about 400, about 450, about 500, about 600, about 700, about 800, about 900, about 1000, about 1500, about 2000, about 2500, or about 3000, or more, or e.g., greater than 1 and about 1 to 2, about 2 to 3, about 3 to 4, about 4 to 5, greater than 1 and about 1 to 10, greater than 1 and about 1 to 20, greater than 1 and about 1 to 30, greater than 1 and about 1 to 40, greater than 1 and about 1 to 50, about 2 to 10, about 2 to 20, about 2 to 30, about 2 to 40, 2 to 50, about 5 to 10, about 5 to 20, about 5 to 30, about 5 to 40, about 5 to 50, about 10 to 20, about 10 to 30, about 10 to 40 about 10 to 50, about 20 to 40, about 20 to 50, about 50 to 100, about 100 to 200, about 200 to 500, about 500 to 1000, about 1000 to 2000, or about 1000 to 3000, relative to an IL-2 agent comprising a wild-type IL-2 or an IL-2 agent comprising a reference IL-2 variant e.g., as determined flow cytometry. In an embodiment, the T helper cell is a CD45+ CD3+CD4+Foxp3− cell, e.g., determined by flow cytometry. In an embodiment, the Treg is CD45+CD3+CD4+ Foxp3+ cell, e.g., determined by flow cytometry.

In an embodiment, the IL-2 agent selectively activates IL-2 signaling in T regulatory cells in vitro and/or in vivo, e.g., having an NK cell EC50/Treg EC50 ratio greater than about 1, about 2, about 3, about 4, about 5, about 6, about 7, about 8, about 9, about 10, about 11, about 12, about 13, about 14, about 15, about 16, about 17, about 18, about 19, about 20, about 21, about 22, about 23, about 24, about 25, about 26, about 27, about 28, about 29, about 30, about 35, about 40, about 45, about 50, about 55, about 60, about 65, about 70, about 75, about 80, about 85, about 90, about 95, about 100, about 150, about 200, about 250, about 300, about 350, about 400, about 450, about 500, about 600, about 700, about 800, about 900, about 1000, about 1500, about 2000, about 2500, or about 3000, or more, or e.g., greater than 1 and about 1 to 2, about 2 to 3, about 3 to 4, about 4 to 5, greater than 1 and about 1 to 10, greater than 1 and about 1 to 20, greater than 1 and about 1 to 30, greater than 1 and about 1 to 40, greater than 1 and about 1 to 50, about 2 to 10, about 2 to 20, about 2 to 30, about 2 to 40, 2 to 50, about 5 to 10, about 5 to 20, about 5 to 30, about 5 to 40, about 5 to 50, about 10 to 20, about 10 to 30, about 10 to 40 about 10 to 50, about 20 to 40, about 20 to 50, about 50 to 100, about 100 to 200, about 200 to 500, about 500 to 1000, about 1000 to 2000, or about 1000 to 3000, relative to an IL-2 agent comprising a wild-type IL-2 or an IL-2 agent comprising a reference IL-2 variant e.g., as determined flow cytometry. In an embodiment, the NK cell is a CD45+CD3− cell that is CD56+ and/or CD16+, e.g., determined by flow cytometry. In an embodiment, the NK cell is a CD45+CD3− CD56+ cell, e.g., determined by flow cytometry. In an embodiment, the Treg is CD45+CD3+CD4+Foxp3+ cell, e.g., determined by flow cytometry.

In an embodiment, the IL-2 agent has enhanced or increased potency and/or ability to induce or promote T regulatory cell activity, e.g., having an EC50 for Tregs that is lower by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant e.g., as determined flow cytometry, a T regulatory cell proliferation or expansion assay in vitro or in vivo, and/or a T cell suppression assay.

In an embodiment, the IL-2 agent as reduced or decreased potency and/or ability to induce or promote T regulatory cell activity, e.g., having an EC50 for Tregs that is higher by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, about 50-fold, about 100-fold, about 200-fold, about 500-fold, about 1000-fold, about 2000-fold, about 5000-fold, about 10,000-fold, about 15,000-fold, about 20,000-fold or more e.g., relative to an IL-2 agent comprising a wild-type IL-2 or an IL-2 agent comprising a reference IL-2 variant e.g., as determined flow cytometry, a T regulatory cell proliferation or expansion assay in vitro or in vivo, and/or a T cell suppression assay. In an embodiment, the IL-2 agent has reduced or decreased potency and/or ability to induce or promote T regulatory cell activity, e.g., having an EC50 for Tregs that is higher by about 100-fold or more, relative to an IL-2 agent comprising a wild-type IL-2 or an IL-2 agent comprising a reference IL-2 variant (e.g., as determined flow cytometry, a T regulatory cell proliferation or expansion assay in vitro or in vivo, and/or a T cell suppression assay), and does not activate, or does not significantly activate, NK cells.

In an embodiment, the IL-2 agent modulates (e.g., reduces (e.g., inhibits, blocks, or neutralizes) or increases (e.g., activates, initiates, or enhances) one or more biological activities of a T cell (e.g., Treg), in vitro, ex vivo, or in vivo.

In an embodiment, the IL-2 agent shows the same or similar binding affinity or specificity, or both, as an IL-2 agent described herein.

In an embodiment, the IL-2 agent shows the same or similar binding affinity or specificity, or both, as an IL-2 agent comprising one or more (e.g., 2, 3, 4, 5, 6, 7, 8, 9, 10, or more) alterations (e.g., substitutions) described herein.

In an embodiment, the IL-2 agent shows the same or similar binding affinity or specificity, or both, as an IL-2 agent comprising an amino acid sequence described herein.

In an embodiment, the IL-2 agent shows the same or similar binding affinity or specificity, or both, as an IL-2 agent comprising an amino acid sequence encoded by a nucleotide sequence described herein.

In an embodiment, the IL-2 agent inhibits, e.g., competitively inhibits, the binding of a second IL-2 agent to an IL-2 receptor, wherein the second IL-2 agent is an IL-2 agent described herein. In an embodiment, the IL-2 agent competes for binding to an IL-2 receptor with a second IL-2 agent, wherein the second IL-2 agent is an IL-2 agent described herein.

In an embodiment, the IL-2 agent has one or more biological properties of an IL-2 agent described herein.

In an embodiment, the IL-2 agent has one or more structural properties of an IL-2 agent described herein.

In an embodiment, the IL-2 agent has one or more pharmacokinetic properties of an IL-2 agent described herein.

In an embodiment, the interleukin-2 (IL-2) agent comprises a human IL-2 variant comprising an amino acid alteration (e.g., substitution) at one or more (e.g., 1, 2, 3, 4, 5, 6, 7, 8, 9, 10, 11, 12, 13, 14, or all) position(s) chosen from: T3, H16, I28, K35, R38, F42, E68, V69, Q74, D84, S87, N88, I92, C125, Q126, or a combination thereof, e.g., corresponding to wild-type human IL-2. In another embodiment, the IL-2 agent comprises an amino acid alteration (e.g., substitution) at position V69, Q74, or a combination thereof. In an embodiment, the IL-2 agent comprises an amino acid alteration (e.g., substitution) at positions V69 and Q74. In an embodiment, the IL-2 agent comprises the amino acid substitution V69A. In an embodiment, the IL-2 agent comprises the amino acid substitution Q74P. In an embodiment, the IL-2 agent comprises an amino acid alteration (e.g., substitution) at position H16, I92, D84, or a combination thereof. In an embodiment, the IL-2 agent comprises an amino acid alteration (e.g., substitution) at position H16, optionally wherein the amino acid substitution is H16N, H16L, or H16D. In an embodiment, the IL-2 agent comprises the amino acid substitution H16N. In an embodiment, the IL-2 agent comprises the amino acid substitution H16L. In an embodiment, the IL-2 agent comprises an amino acid alteration (e.g., substitution) at position at I92, optionally wherein the amino acid substitution is I92S. In an embodiment, the IL-2 agent comprises an amino acid alteration (e.g., substitution) at position D84, optionally wherein the amino acid substitution is D84V. In an embodiment, the IL-2 agent comprises an amino acid alteration (e.g., substitution) at position K35, R38, F42, E68, or a combination thereof. In an embodiment, the IL-2 agent comprises an amino acid alteration (e.g., substitution) at position K35, optionally wherein the amino acid substitution is K35E. In an embodiment, the IL-2 agent comprises an amino acid alteration (e.g., substitution) at position R38, optionally wherein the amino acid substitution is R38E, R38N or R38Q. In an embodiment, the IL-2 agent comprises the amino acid substitution R38N. In an embodiment, the IL-2 agent comprises the amino acid substitution R38Q. In an embodiment, the IL-2 agent comprises an amino acid alteration (e.g., substitution) at position F42, optionally wherein the amino acid substitution is F42K or F42Q. In an embodiment, the IL-2 agent comprises the amino acid substitution F42Q.

In an embodiment, the IL-2 agent comprises one or more (e.g., two, three, four, or all) of (i)-(v):

(i) one or more (e.g., two, three, four, five, six, or seven) amino acid alterations (e.g., substitutions) that reduce, or are identified to reduce, its affinity for CD122 (e.g., CD122/CD132 heterodimer), e.g., an alteration (e.g., substitution) at position H16 (e.g., H16L, H16N, or H16D), I28 (e.g., I28T or I28F), D84 (e.g., D84V), S87 (e.g., S87R), N88 (e.g., N88S, N88L, or N88D), I92 (e.g., I92S), and/or Q126 (e.g., Q126T, Q126K, or Q126R);

(ii) one or more (e.g., two) amino acid alterations (e.g., substitutions) that increase, or are identified to increase, the stability of the IL-2 agent, e.g., an alteration (e.g., substitution) at position V69 (e.g., V69A) and/or Q74 (e.g., Q74P);

(iii) one or more (e.g., two, three, or four) amino acid alterations (e.g., substitutions) that reduce, or are identified to reduce, its affinity for CD25, e.g., an alteration (e.g., substitution) at position K35 (e.g., K35E), R38 (e.g., R38E, R38N, or R38Q), F42 (e.g., F42K or F42Q), and/or E68 (e.g., E68Q or E68N); or (iv) one or more amino acid alterations (e.g., substitutions) that reduce, or are identified to reduce, O-glycosylation of the IL-2 agent, e.g., an alteration (e.g., substitution) at position T3 (e.g., T3A); or (v) one or more amino acid alterations (e.g., substitutions) that reduce, or are identified to reduce, incorrect disulfide pairing and/or aggregation (e.g., to improve stability) of the IL-2 agent, e.g., an alteration (e.g., substitution) at position C125 (e.g., C125S).

In an embodiment, the IL-2 agent comprises (i). In an embodiment, the IL-2 agent comprises (ii). In an embodiment, the IL-2 agent comprises (iii). In an embodiment, the IL-2 agent comprises (iv). In an embodiment, the IL-2 agent comprises (v).

In an embodiment, the IL-2 agent comprises (i) and (ii). In an embodiment, the IL-2 agent comprises (i) and (iii). In an embodiment, the IL-2 agent comprises (i) and (iv). In an embodiment, the IL-2 agent comprises (i) and (v). In an embodiment, the IL-2 agent comprises (ii) and (iii). In an embodiment, the IL-2 agent comprises (ii) and (iv). In an embodiment, the IL-2 agent comprises (ii) and (v). In an embodiment, the IL-2 agent comprises (iii) and (iv). In an embodiment, the IL-2 agent comprises (iii) and (v). In an embodiment, the IL-2 agent comprises (iv) and (v).

In an embodiment, the IL-2 agent comprises (i), (ii), and (iii). In an embodiment, the IL-2 agent comprises (i), (ii), and (iv). In an embodiment, the IL-2 agent comprises (i), (ii), and (v). In an embodiment, the IL-2 agent comprises (i), (iii), and (iv). In an embodiment, the IL-2 agent comprises (i), (iii), and (v). In an embodiment, the IL-2 agent comprises (i), (iv), and (v). In an embodiment, the IL-2 agent comprises (ii), (iii), and (iv). In an embodiment, the IL-2 agent comprises (ii), (iii), and (v). In an embodiment, the IL-2 agent comprises (ii), (iv), and (iv). In an embodiment, the IL-2 agent comprises (iii), (iv), and (v).

In an embodiment, the IL-2 agent comprises (i), (ii), (iii), and (iv). In an embodiment, the IL-2 agent comprises (i), (ii), (iii), and (v). In an embodiment, the IL-2 agent comprises (i), (ii), (iv), and (v). In an embodiment, the IL-2 agent comprises (i), (iii), (iv), and (v). In an embodiment, the IL-2 agent comprises (ii), (iii), (iv), and (v).

In an embodiment, the IL-2 agent comprises (i), (ii), (iii), (iv), and (v).

In an embodiment, the IL-2 agent does not comprise (i). In an embodiment, the IL-2 agent does not comprise (ii). In an embodiment, the IL-2 agent does not comprise (iii). In an embodiment, the IL-2 agent does not comprise (iv). In an embodiment, the IL-2 agent does not comprise (v).

In an embodiment, the IL-2 agent does not comprise (i) and (ii). In an embodiment, the IL-2 agent does not comprise (i) and (iii). In an embodiment, the IL-2 agent does not comprise (i) and (iv). In an embodiment, the IL-2 agent does not comprise (i) and (v). In an embodiment, the IL-2 agent does not comprise (ii) and (iii). In an embodiment, the IL-2 agent does not comprise (ii) and (iv). In an embodiment, the IL-2 agent does not comprise (ii) and (v). In an embodiment, the IL-2 agent does not comprise (iii) and (iv). In an embodiment, the IL-2 agent does not comprise (iii) and (v). In an embodiment, the IL-2 agent does not comprise (iv) and (v).

In an embodiment, the IL-2 agent does not comprise (i), (ii), and (iii). In an embodiment, the IL-2 agent does not comprise (i), (ii), and (iv). In an embodiment, the IL-2 agent does not comprise (i), (ii), and (v). In an embodiment, the IL-2 agent does not comprise (i), (iii), and (iv). In an embodiment, the IL-2 agent does not comprise (i), (iii), and (v). In an embodiment, the IL-2 agent does not comprise (i), (iv), and (v). In an embodiment, the IL-2 agent does not comprise (ii), (iii), and (iv). In an embodiment, the IL-2 agent does not comprise (ii), (iii), and (v). In an embodiment, the IL-2 agent does not comprise (ii), (iv), and (iv). In an embodiment, the IL-2 agent does not comprise (iii), (iv), and (v).

In an embodiment, the IL-2 agent does not comprise (i), (ii), (iii), and (iv). In an embodiment, the IL-2 agent does not comprise (i), (ii), (iii), and (v). In an embodiment, the IL-2 agent does not comprise (i), (ii), (iv), and (v). In an embodiment, the IL-2 agent does not comprise (i), (iii), (iv), and (v). In an embodiment, the IL-2 agent does not comprise (ii), (iii), (iv), and (v).

In an embodiment, the IL-2 agent does not comprise (i), (ii), (iii), (iv), and (v).

In an embodiment, the IL-2 agent comprises an amino acid alteration (e.g., substitution):
(i) at position V69 and Q74, and/or at position K35; and
(ii) at position H16, I92, or D84; and optionally
(iii) at position R38, F42, E68, or a combination thereof.

In an embodiment, the IL-2 agent comprises an amino acid alteration (e.g., substitution):
(i) at position V69 and Q74, and/or at position K35; and
(ii) at position H16, I92, or D84; and
(iii) at position R38, F42, E68, or a combination thereof.

In an embodiment, the IL-2 agent comprises an amino acid alteration (e.g., substitution):
(i) at position V69 and Q74, and/or at position K35; and
(ii) at position H16, I92, or D84; or
(iii) at position R38, F42, E68, or a combination thereof.

In an embodiment, the IL-2 agent comprises an amino acid alteration (e.g., substitution):
(i) at position V69 and Q74; and/or at position K35; and
(ii) at position H16, I92, D84, or a combination thereof, and
(iii) at position R38, F42, E68, or a combination thereof.

In an embodiment, the IL-2 agent comprises an amino acid alteration (e.g., substitution) at position V69, Q74, and H16, optionally wherein the amino acid substitution is V69A, Q74P, and H16N or H16L, respectively, optionally wherein the amino acid substitutions are V69A, Q74P, and H16L. In an embodiment, the IL-2 agent comprises the amino acid substitutions V69A, Q74P, and H16L.

In an embodiment, the IL-2 agent comprises an amino acid alteration (e.g., substitution) at position V69, Q74, and I92, optionally wherein the amino acid substitution is V69A, Q74P, and I92S, respectively. In an embodiment, the IL-2 agent comprises the amino acid substitutions V69A, Q74P, and I92S.

In an embodiment, the IL-2 agent comprises an amino acid alteration (e.g., substitution) at position V69, Q74, and D84, optionally wherein the amino acid substitution is V69A, Q74P, and D84V, respectively. In an embodiment, the IL-2 agent comprises the amino acid substitutions V69A, Q74P, and D84V.

In an embodiment, the IL-2 agent comprises an amino acid alteration (e.g., substitution) at position V69, Q74, and R38, optionally wherein the amino acid substitution is V69A, Q74P, and R38Q, respectively.

In an embodiment, the IL-2 agent comprises an amino acid alteration (e.g., substitution) at position V69, Q74, and F42, optionally wherein the amino acid substitution is V69A, Q74P, and F42Q, respectively. In an embodiment, the IL-2 agent comprises the amino acid substitutions V69A, Q74P, and F42Q.

In an embodiment, the IL-2 agent comprises an amino acid alteration (e.g., substitution) at position V69, Q74, and R38, optionally wherein the amino acid substitution is V69A, Q74P, and R38N, respectively. In an embodiment, the IL-2 agent comprises the amino acid substitutions V69A, Q74P, and R38N.

In an embodiment, the IL-2 agent comprises an amino acid alteration (e.g., substitution) at position V69, Q74, and R38, optionally wherein the amino acid substitution is V69A, Q74P, and R38E, respectively. In an embodiment, the IL-2 agent comprises the amino acid substitutions V69A, Q74P, and R38E.

In an embodiment, the IL-2 agent comprises an amino acid alteration (e.g., substitution) at position V69, Q74, K35, and H16, optionally wherein the amino acid substitution is V69A, Q74P, K35E, and H16N or H16L, respectively. In an embodiment, the IL-2 agent comprises the amino acid substitutions V69A, Q74P, K35E, and H16N or H16L. In an embodiment, the IL-2 agent comprises the amino acid substitutions V69A, Q74P, K35E, and H16N. In an embodiment, the IL-2 agent comprises the amino acid substitution is V69A, Q74P, K35E, and H16L.

In an embodiment, the IL-2 agent comprises an amino acid alteration (e.g., substitution) at position V69, Q74, K35, H16, and R38, optionally wherein the amino acid substitution is V69A, Q74P, K35E, H16N, and R38N, respectively. In an embodiment, the IL-2 agent comprises the amino acid substitutions V69A, Q74P, K35E, H16N, and R38N.

In an embodiment, the IL-2 agent comprises an amino acid alteration (e.g., substitution) at position V69, Q74, H16, and R38, optionally wherein the amino acid substation is V69A, Q74P, H16N or H16L, and R38N or R38Q, respectively, optionally wherein the amino acid substitutions are V69A, Q74P, H16N or H16L, and R38Q. In an embodiment, the IL-2 agent comprises the amino acid substitutions V69A, Q74P, H16L, and R38Q.

In an embodiment, the IL-2 agent comprises an amino acid alteration (e.g., substitution) at position 128, E68, S87, N88, Q126, or a combination thereof. In an embodiment, the IL-2 agent comprises an amino acid alteration (e.g., substitution) at position 128, optionally wherein the amino acid substitution is I28T or I28F. In an embodiment, the IL-2 agent comprises the amino acid substitution I28T. In an embodiment, the IL-2 agent comprises the amino acid substitution I28F.

In an embodiment, the IL-2 agent comprises an amino acid alteration (e.g., substitution) at position E68, optionally wherein the amino acid substitution is E68Q or E68N. In an embodiment, the IL-2 agent comprises the amino acid substitution E68Q. In an embodiment, the IL-2 agent comprises the amino acid substitution E68N.

In an embodiment, the IL-2 agent comprises an amino acid alteration (e.g., substitution) at position S87, optionally wherein the amino acid substitution is S87R. In an embodiment, the IL-2 agent comprises the amino acid substitution S87R.

In an embodiment, the IL-2 agent comprises an amino acid alteration (e.g., substitution) at position N88, optionally wherein the amino acid substitution is N88R, N88S, N88L, or N88D. In an embodiment, the IL-2 agent comprises the amino acid substitution N88R. In an embodiment, the IL-2 agent comprises the amino acid substitution N88S. In an embodiment, the IL-2 agent comprises the amino acid substitution N88L. In an embodiment, the IL-2 agent comprises the amino acid substitution N88D.

In an embodiment, the IL-2 agent comprises an amino acid alteration (e.g., substitution) at position Q126, optionally wherein the amino acid substitution is Q126T, Q126K, or Q126R. In an embodiment, the IL-2 agent comprises the amino acid substitution Q126T. In an embodiment, the IL-2 agent comprises the amino acid substitution Q126K. In an embodiment, the IL-2 agent comprises the amino acid substitution Q126R.

In an embodiment, the IL-2 agent comprises an amino acid alteration (e.g., substitution) at position C125, optionally wherein the amino acid substitution is C125S. In an embodiment, the IL-2 agent comprises the amino acid substitution C125S.

In an embodiment, the IL-2 agent comprises an amino acid alteration (e.g., substitution) at position T3, optionally wherein the amino acid substitution is T3A. In an embodiment, the IL-2 agent comprises the amino acid substitution T3A.

In an embodiment, the IL-2 agent comprises an amino acid alteration (e.g., substitution) at position V69, Q74, and C125, optionally wherein the amino acid substitution is V69A, Q74P, and C125S, respectively. In an embodiment, the IL-2 agent comprises the amino acid substitutions V69A, Q74P, and C125S.

In an embodiment, the IL-2 agent comprises an amino acid alteration (e.g., substitution) at position T3, H16, I92, or a combination thereof, optionally wherein the amino acid substitution is T3A, H16N, and I92S, respectively.

In an embodiment, the IL-2 agent comprises an amino acid alteration (e.g., substitution) at position H16, V69, Q74, and C125, optionally wherein the amino acid substitution is H16N, V69A, Q74P, and C125S, respectively. In an embodiment, the IL-2 agent comprises the amino acid substitutions H16N, V69A, Q74P, and C125S.

In an embodiment, the IL-2 agent comprises an amino acid alteration (e.g., substitution) at position H16, V69, Q74, and C125, optionally wherein the amino acid substitution is H16L, V69A, Q74P, and C125S, respectively. In an embodiment, the IL-2 agent comprises the amino acid substitutions H16L, V69A, Q74P, and C125S. Various technical effects are associated with an IL-2 agent comprising the aforesaid combination of amino acid alterations. Without wishing to be bound by theory, it is believed that in an embodiment, an IL-2 agent comprising the amino acid substitutions H16L, V69A, Q74P, and C125S can have at least one or more of the following advantageous properties: (i) has reduced binding affinity for CD122 and/or CD132, which increases the potency and selectivity of the IL-2 agent for regulatory T cells (Treg) compared to other T cell types; (ii) is significantly stable, e.g., due to the presence of stabilizing V69A and Q74P mutations; (iii) has reduced or decreased (or has no more than a minimal effect on) binding capacity and/or binding affinity for CD25, which improves the lifetime of the IL-2 agent; (iv) does not substantially promote expansion, activation, survival, and/or proliferation of T effector cells and/or natural killer (NK) cells in vitro and/or in vivo; and/or (v) reduced incorrect disulfide pairing and improved stability, e.g., due to the presence of the C125S mutation. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 agent comprising the amino acid substitutions H16L, V69A, Q74P, and C125S particularly suitable for treating disorders and conditions arising from abnormal immune responses, such as autoimmune diseases.

Thus, in an embodiment, an IL-2 agent comprising the amino acid substitutions H16L, V69A, Q74P, and C125S, has inter alia one or more (e.g., 2, 3, 4, 5, 6, 7, or all) of the following properties relative to a wild-type IL-2 or a reference IL-2 variant that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 variant for the heterodimeric IL-2 receptor composed of human CD122 and human CD132 (i.e. human CD122/CD132 heterodimer) in vitro and/or in vivo; (v) reduced or decreased (e.g., moderately reduced or decreased) binding capacity and/or binding affinity for human CD25 in vitro and/or in vivo; (vi) selective binding to regulatory T cells (e.g. Foxp3+ T cells); (vii) selective activation of the IL-2 signaling pathway in T regulatory cells (Tregs) in vitro or in vivo; or (viii) enhanced or increased ability to induce or promote Treg expansion, activity, survival and/or proliferation.

In an embodiment, the IL-2 agent comprises an amino acid alteration (e.g., substitution) at position H16, V69, Q74, I92, and C125, optionally wherein the amino acid substitution is H16L, V69A, Q74P, I92S, and C125S, respectively. In an embodiment, the IL-2 agent comprises the amino acid substitutions H16L, V69A, Q74P, I92S, and C125S.

In an embodiment, the IL-2 agent comprises an amino acid alteration (e.g., substitution) at position T3, V69, Q74, and C125, optionally wherein the amino acid substitution is T3A, V69A, Q74P, and C125S, respectively. In an embodiment, the IL-2 agent comprises the amino acid substitutions T3A, V69A, Q74P, and C125S.

In an embodiment, the IL-2 agent comprises an amino acid alteration (e.g., substitution) at position T3, H16, V69, Q74, and C125, optionally wherein the amino acid substitution is T3A, H16N or H16L, V69A, Q74P, and C125S, respectively. In an embodiment, the IL-2 agent comprises the amino acid substitutions T3A, H16N, V69A, Q74P, and C125S. In an embodiment, the IL-2 agent comprises the amino acid substitutions T3A, H16L, V69A, Q74P, and C125S.

In an embodiment, the IL-2 agent comprises an amino acid alteration (e.g., substitution) at position T3, V69, Q74, 192, and C125, optionally wherein the amino acid substitution is T3A, V69A, Q74P, I92S, and C125S, respectively. In an embodiment, the IL-2 agent comprises the amino acid substitutions T3A, V69A, Q74P, I92S, and C125S. In an embodiment, the IL-2 agent comprises the amino acid substitutions T3A, V69A, Q74P, I92S, and C125S.

In an embodiment, the IL-2 agent comprises a human IL-2 variant comprising an amino acid sequence chosen from: SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, SEQ ID NO: 1002, or a functional fragment thereof, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the amino acid alteration(s) (e.g., substitution(s)) provides the IL-2 agent with at least one or more (e.g., 2, 3, 4, 5, 6, 7, 8, 9, 10, 11, or all) of the following properties relative to a reference IL-2 agent that does not comprise the amino acid alteration(s) (e.g., substitution(s)):
  (i) enhanced or increased expression of the IL-2 agent;
  (ii) inhibited or decreased aggregation of the IL-2 agent;
  (iii) enhanced or increased stability of the IL-2 agent;
  (iv) enhanced or increased half-life of the IL-2 agent;
  (v) inhibited or decreased turnover and/or clearance of the IL-2 agent;
  (vi) inhibited or decreased (e.g., moderately inhibited or decreased) or substantially unchanged binding of the IL-2 agent to human CD25;
  (vii) inhibited or decreased affinity of the IL-2 agent for human CD122;
  (viii) inhibited or decreased affinity of the IL-2 agent for human CD132; or
  (ix) inhibited or decreased affinity of the IL-2 agent for the dimeric IL-2 receptor composed of human CD122 and human CD132;
  (x) selective binding to regulatory T cells (e.g., Foxp3+ T cells);
  (xi) selective activation of the IL-2 signaling pathway in Tregs; or
  (xii) enhanced or increased, or reduced or decreased, ability to induce or promote Treg expansion, activity, survival and/or proliferation.

In an embodiment, the IL-2 agent comprises a human IL-2 variant comprising one or more amino acid alteration(s) (e.g., substitution(s)) chosen from H16D, H16N, H16L, I28T, K35E, R38Q, R38N, R38E, F42K, F42Q, V69A, Q74P, D84V, S87R, N88L, N88S, I92S, C125S; a polypeptide linker described herein; and a non-IL-2 moiety described herein; wherein the amino acid alteration(s) (e.g., substitution(s)) provide(s) the IL-2 agent with at least one or more of the following properties relative to a reference IL-2 agent that does not comprise the amino acid alteration(s) (e.g., substitution(s)):
  (i) enhanced or increased expression of the IL-2 agent;
  (ii) inhibited or decreased aggregation of the IL-2 agent;
  (iii) enhanced or increased stability of the IL-2 agent;
  (iv) enhanced or increased half-life of the IL-2 agent;
  (v) inhibited or decreased turnover and/or clearance of the IL-2 agent;
  (vi) inhibited or decreased (e.g., moderately inhibited or decreased) or substantially unchanged binding of the IL-2 agent to human CD25;
  (vii) inhibited or decreased affinity of the IL-2 agent for human CD122;
  (viii) inhibited or decreased affinity of the IL-2 agent for human CD132;
  (ix) inhibited or decreased affinity of the IL-2 agent for the dimeric IL-2 receptor composed of human CD122 and human CD132;
  (x) selective binding to regulatory T cells (e.g., Foxp3+ T cells);
  (xi) selective activation of the IL-2 signaling pathway in Tregs; and/or
  (xii) enhanced or increased, or reduced or decreased, ability to induce or promote Treg expansion, activity, survival, and/or proliferation.

In an embodiment, the human IL-2 variant comprises the amino acid alteration(s) (e.g., substitution(s)):
  (i) C125S;
  (ii) V69A, Q74P, and C125S;
  (iii) H16D, V69A, Q74P, and C125S;
  (iv) H16N, V69A, Q74P, and C125S;
  (v) H16L, V69A, Q74P, and C125S;
  (vi) I28T, V69A, Q74P, and C125S;
  (vii) V69A, Q74P, D84V, and C125S;
  (viii) V69A, Q74P, S87R, and C125S;
  (ix) V69A, Q74P, N88L, and C125S;
  (x) V69A, Q74P, N88S, and C125S;
  (xi) V69A, Q74P, I92S, and C125S;
  (xii) K35E, V69A, Q74P, and C125S;
  (xiii) K35E, H16N, V69A, Q74P, and C125S;
  (xiv) K35E, H16L, V69A, Q74P, and C125S;
  (xv) K35E, D84V, V69A, Q74P, and C125S;
  (xvi) K35E, I92S, V69A, Q74P, and C125S;
  (xvii) R38Q, V69A, Q74P, and C125S;
  (xviii) R38Q, H16N, V69A, Q74P, and C125S;
  (xix) R38Q, H16L, V69A, Q74P, and C125S;
  (xx) R38Q, D84V, V69A, Q74P, and C125S;
  (xxi) R38Q, I92S, Q74P, and C125S;
  (xxii) R38N, V69A, Q74P, and C125S;
  (xxiii) R38N, H16N, V69A, Q74P, and C125S;
  (xxiv) R38N, H16L, V69A, Q74P, and C125S;
  (xxv) R38N, D84V, V69A, Q74P, and C125S;
  (xxvi) R38N, I92S, Q74P, and C125S;
  (xxvii) R38E, V69A, Q74P, and C125S;
  (xxviii) F42K, V69A, Q74P, and C125S;
  (xxix) F42Q, V69A, Q74P, and C125S;
  (xxx) F42A, Y45A, L72G, N88D, V69A, Q74P, and C125S;
  (xxxi) R38N, S87R, V69A, Q74P, and C125S;
  (xxxii) R38E, H16N, V69A, Q74P, and C125S;
  (xxxiii) R38E, D84V, V69A, Q74P, and C125S;
  (xxxiv) R38E, S87R, V69A, Q74P, and C125S;
  (xxxv) R38E, I92S, V69A, Q74P, and C125S;
  (xxxvi) F42Q, H16N, V69A, Q74P, and C125S;
  (xxxvii) F42Q, I92S, V69A, Q74P, and C125S; or
  (xxxviii) K35E, R38N, H16N, V69A, Q74P, and C125S.
  (xxxix) T3A, H16N, V69A, Q74P, and C125S;
  (xl) T3A, H16L, V69A, Q74P, and C125S; or
  (xli) T3A, V69A, Q74P, I92S, and C125S.

In an embodiment, the IL-2 agent comprises a human IL-2 variant comprising an amino acid sequence chosen from SEQ ID NO: 2, SEQ ID NO: 3, SEQ ID NO: 4, SEQ ID NO:

5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, or SEQ ID NO: 1002, or a functional fragment thereof, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto; a polypeptide linker described herein; and a non-IL-2 moiety described herein; wherein the IL-2 agent exhibits at least one or more of the following properties relative to a reference IL-2 agent that does not comprise the human IL-2 polypeptide variant:

(i) enhanced or increased expression of the IL-2 agent;
(ii) inhibited or decreased aggregation of the IL-2 agent;
(iii) enhanced or increased stability of the IL-2 agent;
(iv) enhanced or increased half-life of the IL-2 agent;
(v) inhibited or decreased turnover and/or clearance of the IL-2 agent;
(vi) inhibited or decreased (e.g., moderately inhibited or decreased) or substantially unchanged binding of the IL-2 agent to human CD25;
(vii) inhibited or decreased affinity of the IL-2 agent for human CD122;
(viii) inhibited or decreased affinity of the IL-2 agent for human CD132;
(ix) inhibited or decreased affinity of the IL-2 agent for dimeric IL-2 receptor composed of human CD122 and human CD132;
(x) selective binding to regulatory T cells (e.g., Foxp3+ T cells);
(xi) selective activation of the IL-2 signaling pathway in Tregs; and/or
(xii) enhanced or increased, or reduced or decreased, ability to induce or promote Treg expansion, activity and/or proliferation.

Various technical effects are associated with an IL-2 agent comprising the amino acid sequence of SEQ ID NO: 5. Without wishing to be bound by theory, it is believed that in an embodiment, an IL-2 agent comprising the amino acid sequence of SEQ ID NO: 5 can have at least one or more of the following advantageous properties: (i) has reduced binding affinity for CD122 and/or CD132, which increases the potency and selectivity of the IL-2 agent for regulatory T cells (Treg) compared to other T cell types; (ii) is significantly stable, e.g., due to the presence of stabilizing V69A and Q74P mutations; (iii) has reduced or decreased (or has no more than a minimal effect on) binding capacity and/or binding affinity for CD25, which improves the lifetime of the IL-2 agent; (iv) does not substantially promote expansion, activation, survival, and/or proliferation of T effector cells and/or natural killer (NK) cells in vitro and/or in vivo; and/or (v) has reduced incorrect disulfide pairing and improved stability, e.g., due to the presence of the C125S mutation. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 agent comprising the amino acid sequence of SEQ ID NO: 5 particularly suitable for treating disorders and conditions arising from abnormal immune responses, such as autoimmune diseases.

Thus, in an embodiment, an IL-2 agent comprising the amino acid sequence of SEQ ID NO: 5, has inter alia one or more (e.g., 2, 3, 4, 5, 6, 7, or all) of the following properties relative to a wild-type IL-2 or a reference IL-2 variant that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 variant for the heterodimeric IL-2 receptor composed of human CD122 and human CD132 (i.e. human CD122/CD132 heterodimer) in vitro and/or in vivo; (v) reduced or decreased (e.g., moderately reduced or decreased) binding capacity and/or binding affinity for human CD25 in vitro and/or in vivo; (vi) selective binding to regulatory T cells (e.g. Foxp3+ T cells); (vii) selective activation of the IL-2 signaling pathway in T regulatory cells (Tregs) in vitro or in vivo; or (viii) enhanced or increased ability to induce or promote Treg expansion, activity, survival and/or proliferation.

In an embodiment, the reference IL-2 agent comprises the amino acid sequence of SEQ ID NO: 1031, SEQ ID NO: 1, or SEQ ID NO: 2, or a functional fragment thereof. In an embodiment, the reference IL-2 agent comprises the amino acid sequence of SEQ ID NO: 1031. In an embodiment, the reference IL-2 agent comprises the amino acid sequence of SEQ ID NO: 1. In an embodiment, the reference IL-2 agent comprises the amino acid sequence of SEQ ID NO: 2.

In an embodiment, the IL-2 agent comprises a human IL-2 variant described herein fused to a non-IL-2 moiety described herein by a linker, wherein the linker is a polypeptide linker, optionally wherein the polypeptide linker is a flexible linker, a rigid linker, or a cleavable linker. In an embodiment, the polypeptide linker is a Gly-Ser linker (e.g., a (G4S)n linker, wherein n=1, 2, 3, 4, 5, 6 or more (SEQ ID NO: 1020)), a proline-rich extended linker (e.g., V1 GPc, V2, GPGc, V3 GcGcP, cellulase linker 4, cellulase linker 4), a rigid linker (e.g., A(EAAAK)nA, wherein n=2, 3, 4, 5, or more (SEQ ID NO: 1021); REPR_12), a non-GS linker (e.g., (GGGSA)n, wherein n=1, 2, 3, 4, 5, or more (SEQ ID NO: 1022)), or an immunoglobulin hinge region or portion thereof. In an embodiment, the polypeptide linker is a Gly-Ser linker comprising (G4S)$_1$ (SEQ ID NO: 1023), (G4S)$_2$ (SEQ ID NO: 1024), (G4S)$_3$ (SEQ ID NO: 1025), (G4S)$_4$ (SEQ ID NO: 48), (G4S)$_5$ (SEQ ID NO: 1026), or (G4S)$_6$ (SEQ ID NO: 1027). In an embodiment, the polypeptide linker is a Gly-Ser linker comprising (G4S)$_4$ (SEQ ID NO: 48). In an embodiment, the polypeptide linker comprises an amino acid sequence chosen from SEQ ID NO: 48, SEQ ID NO: 49, SEQ ID NO: 50, SEQ ID NO: 51, SEQ ID NO: 52, SEQ ID NO: 53, SEQ ID NO: 54, or SEQ ID NO: 55. In an embodiment, the polypeptide linker comprises the amino acid sequence of SEQ ID NO: 48.

In an embodiment, the non-IL-2 moiety is an immunoglobulin Fc region, or a fragment or portion thereof (e.g., a functional fragment). In an embodiment, the immunoglobulin Fc region comprises an IgG Fc region, an IgD Fc region, an IgA Fc region, an IgM Fc region, or an IgE Fc region, or fragment or portion thereof. In an embodiment, the IgG Fc region comprises a wild type human IgG1 Fc region (e.g., IgG1 m3 allotype), a wild type IgG2 Fc region, or a wild type human IgG4 Fc region, or a fragment or portion thereof.

In an embodiment, the IgG Fc region comprises a mutant IgG1 or mutant IgG4 Fc region, or a fragment or portion thereof. In an embodiment, the IgG Fc region comprises one or more (e.g., two, three, four, or five) mutations, e.g., one or more (e.g., two, three, four, or five) mutations described herein.

In an embodiment, the IgG Fc region comprises a mutant IgG4 Fc region, or a fragment or portion thereof, wherein the mutant IgG4 Fc region is human.

In an embodiment, the mutant IgG4 Fc region, or fragment or portion thereof, comprises an amino acid alteration (e.g., substitution) at Ser228, numbering according to EU numbering, optionally wherein the amino acid alteration (e.g., substitution) at Ser228 is S228P. In an embodiment, the mutant IgG4 Fc region comprises the amino acid substitution S228P.

In an embodiment, the mutant IgG4 Fc region, or fragment or portion thereof, comprises an amino acid alteration (e.g., substitution) at Arg409, numbering according to EU numbering, optionally wherein the amino acid alteration (e.g., substitution) at Arg409 is R409K. In an embodiment, the mutant IgG4 Fc region comprises the amino acid substitution R409K.

In an embodiment, the mutant IgG4 Fc region, or a fragment or portion thereof, comprises amino acid alterations (e.g., substitutions) at Thr307, Gln311, and Ala378, numbering according to EU numbering, optionally wherein the amino acid alterations (e.g., substitutions) are T307Q, Q311V, and A378V, respectively. In an embodiment, the mutant IgG4 Fc region comprises the amino acid substitutions T307Q, Q311V, and A378V.

In an embodiment, the mutant IgG4 Fc region comprises an amino acid sequence chosen from SEQ ID NO: 44, SEQ ID NO: 45, SEQ ID NO: 46, or SEQ ID NO: 47, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IgG Fc region comprises a mutant IgG1 Fc region, or a fragment or portion thereof, wherein the mutant IgG1 Fc region is human. In an embodiment, the mutant IgG1 Fc region (e.g., comprising an N297G substitution) has an IgG1 m3 allotype.

In an embodiment, the mutant IgG1 Fc region, or a fragment or portion thereof, comprises an amino acid alteration (e.g., substitution) at Asn297, numbering according to EU numbering, optionally wherein the amino acid alteration (e.g., substitution) at Asn297 is N297G. In an embodiment, the mutant IgG1 Fc region comprises the amino acid substitution N297G.

In an embodiment, the mutant IgG1 Fc region, or a fragment or portion thereof, comprises amino acid alterations (e.g., substitutions) at Leu234, Leu235, and Pro329, numbering according to EU numbering, optionally wherein the amino acid alterations (e.g., substitutions) are L234A, L235A, and P329G, respectively. In an embodiment, the mutant IgG1 Fc region comprises the amino acid substitutions L234A, L235A, and P329G.

In an embodiment, the mutant IgG1 Fc region, or a fragment or portion thereof, comprises amino acid alterations (e.g., substitutions) at Thr307, Gln311, and Ala378, numbering according to EU numbering, optionally wherein the amino acid alterations (e.g., substitutions) are T307Q, Q311V, and A378V, respectively. In an embodiment, the mutant IgG1 Fc region comprises the amino acid substitutions T307Q, Q311V, and A378V.

In an embodiment, the mutant IgG1 Fc region comprises an amino acid sequence chosen from SEQ ID NO: 40, SEQ ID NO: 41, SEQ ID NO: 42, SEQ ID NO: 43, or SEQ ID NO: 1003, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the mutant IgG1 Fc region comprises an amino acid sequence of SEQ ID NO: 1003, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the mutant IgG1 Fc region comprises an amino acid sequence of SEQ ID NO: 1003.

In an embodiment, the non-IL-2 moiety inhibits or decreases the ability of the IL-2 agent to elicit Fc-receptor-mediated immune effector functions.

In an embodiment, the IL-2 agent comprises an IL-2 variant comprising an amino acid sequence chosen from SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, or SEQ ID NO: 38, SEQ ID NO: 1000, SEQ ID NO: 1001, or SEQ ID NO: 1002, or a functional fragment thereof; wherein the IL-2 agent comprises a Gly-Ser linker, optionally wherein the Gly-Ser linker comprises (G4S)$_4$ (SEQ ID NO: 48), and wherein the IL-2 variant is fused by the Gly-Ser linker to an IgG Fc region comprising an amino acid sequence chosen from SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, or SEQ ID NO: 1003.

In an embodiment, the IL-2 agent comprises an amino acid sequence chosen from SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 1004, SEQ ID NO: 1005, SEQ ID NO: 1006, SEQ ID NO: 1007, SEQ ID NO: 1008, or SEQ ID NO: 1009, or a functional fragment thereof.

In an embodiment, the IL-2 agent comprises an amino acid sequence chosen from SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, or SEQ ID NO: 131, or a functional fragment thereof.

In an embodiment, the IL-2 agent comprises an amino acid sequence chosen from SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, or SEQ ID NO: 169, or a functional fragment thereof.

In an embodiment, the IL-2 agent comprises an amino acid sequence chosen from SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, or SEQ ID NO: 207, or a functional fragment thereof.

In an embodiment, the IL-2 agent comprises an amino acid sequence chosen from SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, or SEQ ID NO: 245, or a functional fragment thereof.

In an embodiment, the IL-2 agent comprises an amino acid sequence chosen from SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, or SEQ ID NO: 283, or a functional fragment thereof.

In an embodiment, the IL-2 agent comprises an amino acid sequence chosen from SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, or SEQ ID NO: 321, or a functional fragment thereof.

In an embodiment, the IL-2 agent comprises an amino acid sequence chosen from SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, or SEQ ID NO: 359, or a functional fragment thereof.

In an embodiment, the IL-2 agent comprises the amino acid sequence of SEQ ID NO: 59, or a functional fragment thereof. In an embodiment, the IL-2 agent comprises the amino acid sequence of SEQ ID NO: 97, or a functional fragment thereof. In an embodiment, the IL-2 agent comprises the amino acid sequence of SEQ ID NO: 135, or a functional fragment thereof. In an embodiment, the IL-2 agent comprises the amino acid sequence of SEQ ID NO: 173, or a functional fragment thereof. In an embodiment, the IL-2 agent comprises the amino acid sequence of SEQ ID NO: 211, or a functional fragment thereof. In an embodiment, the IL-2 agent comprises the amino acid sequence of SEQ ID NO: 249, or a functional fragment thereof. In an embodiment, the IL-2 agent comprises the amino acid sequence of SEQ ID NO: 287, or a functional fragment thereof. In an embodiment, the IL-2 agent comprises the amino acid sequence of SEQ ID NO: 325, or a functional fragment thereof. In an embodiment, the IL-2 agent comprises the amino acid sequence of SEQ ID NO: 66, or a functional fragment thereof. In an embodiment, the IL-2 agent comprises the amino acid sequence of SEQ ID NO: 104, or a functional fragment thereof. In an embodiment, the IL-2 agent comprises the amino acid sequence of SEQ ID NO: 142, or a functional fragment thereof. In an embodiment, the IL-2 agent comprises the amino acid sequence of SEQ ID NO: 180, or a functional fragment thereof. In an embodiment, the IL-2 agent comprises the amino acid sequence of SEQ ID NO: 218, or a functional fragment thereof. In an embodiment, the IL-2 agent comprises the amino acid sequence of SEQ ID NO: 256, or a functional fragment thereof. In an embodiment, the IL-2 agent comprises the amino acid sequence of SEQ ID NO: 294, or a functional fragment thereof. In an embodiment, the IL-2 agent comprises the amino acid sequence of SEQ ID NO: 332, or a functional fragment thereof. In an embodiment, the IL-2 agent comprises the amino acid sequence of SEQ ID NO: 60, or a functional fragment thereof. In an embodiment, the IL-2 agent comprises the amino acid sequence of SEQ ID NO: 98, or a functional fragment thereof. In an embodiment, the IL-2 agent comprises the amino acid sequence of SEQ ID NO: 136, or a functional fragment thereof. In an embodiment, the IL-2 agent comprises the amino acid sequence of SEQ ID NO: 174, or a functional fragment thereof. In an embodiment, the IL-2 agent comprises the amino acid sequence of SEQ ID NO: 212, or a functional fragment thereof. In an embodiment, the IL-2 agent comprises the amino acid sequence of SEQ ID NO: 250, or a functional fragment thereof. In an embodiment, the IL-2 agent comprises the amino acid sequence of SEQ ID NO: 288, or a functional fragment thereof. In an embodiment, the IL-2 agent comprises the amino acid sequence of SEQ ID NO: 326, or a functional fragment thereof. In an embodiment, the IL-2 agent comprises the amino acid sequence of SEQ ID NO: 69, or a functional fragment thereof. In an embodiment, the IL-2 agent comprises the amino acid sequence of SEQ ID NO: 107, or a functional fragment thereof. In an embodiment, the IL-2 agent comprises the amino acid sequence of SEQ ID NO: 145, or a functional fragment thereof. In an embodiment, the IL-2 agent comprises the amino acid sequence of SEQ ID NO: 183, or a functional fragment thereof. In an embodiment, the IL-2 agent comprises the amino acid sequence of SEQ ID NO: 221, or a functional fragment thereof. In an embodiment, the IL-2 agent comprises the amino acid sequence of SEQ ID NO: 259, or a functional fragment thereof. In an embodiment, the IL-2 agent comprises the amino acid sequence of SEQ ID NO: 297, or a functional fragment thereof. In an embodiment, the IL-2 agent comprises the amino acid sequence of SEQ ID NO: 335, or a functional fragment thereof. In an embodiment, the IL-2 agent comprises the amino acid sequence of SEQ ID NO: 1004, or a functional fragment thereof. In an embodiment, the IL-2 agent comprises the amino acid sequence of SEQ ID NO: 1005, or a functional fragment thereof. In an embodiment, the IL-2 agent comprises the amino acid sequence of SEQ ID NO: 1006, or a functional fragment thereof. In an embodiment, the IL-2 agent comprises the amino acid sequence of SEQ ID NO: 1007, or a functional fragment thereof. In an embodiment, the IL-2 agent comprises the amino acid sequence of SEQ ID NO: 1008, or a functional fragment thereof. In an embodiment, the IL-2 agent comprises the amino acid sequence of SEQ ID NO: 1009, or a functional fragment thereof.

Various technical effects are associated with an IL-2 agent comprising the amino acid sequence of SEQ ID NO: 1008. Without wishing to be bound by theory, it is believed that in an embodiment, an IL-2 agent comprising the amino acid sequence of SEQ ID NO: 1008 can have at least one or more of the following advantageous properties: (i) has reduced binding affinity for CD122 and/or CD132, which increases the potency and selectivity of the IL-2 agent for regulatory T cells (Treg) compared to other T cell types; (ii) is significantly stable, e.g., due to the presence of stabilizing V69A and Q74P mutations; (iii) has reduced or decreased (or has no more than a minimal effect on) binding capacity and/or binding affinity for CD25, which improves the lifetime of the IL-2 agent; (iv) does not substantially promote expansion, activation, survival, and/or proliferation of T effector cells and/or natural killer (NK) cells in vitro and/or in vivo; and/or (v) has reduced incorrect disulfide pairing and improved stability, e.g., due to the presence of the C125S mutation. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 variant an IL-2 agent comprising the amino acid sequence of SEQ ID NO: 1008 particularly suitable for treating disorders and conditions arising from abnormal immune responses, such as autoimmune diseases.

Thus, in an embodiment, an IL-2 agent comprising the amino acid sequence of SEQ ID NO: 1008, has inter alia one or more (e.g., 2, 3, 4, 5, 6, 7, or all) of the following properties relative to a wild-type IL-2 or a reference IL-2 variant that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 variant for the heterodimeric IL-2 receptor composed of human CD122 and human CD132 (i.e. human CD122/CD132 heterodimer) in vitro and/or in vivo; (v) reduced or decreased (e.g., moderately reduced or decreased) binding capacity and/or binding affinity for human CD25 in vitro and/or in vivo; (vi) selective binding to regulatory T cells (e.g. Foxp3+ T cells); (vii) selective activation of the IL-2 signaling pathway in T regulatory cells (Tregs) in vitro or in vivo; or (viii) enhanced or increased ability to induce or promote Treg expansion, activity, survival and/or proliferation.

In an embodiment, the IL-2 agent forms a dimer (e.g., a homodimer or heterodimer).

In an embodiment, the IL-2 agent comprises an IL-2 fusion protein. In an embodiment, the IL-2 agent comprises an IL-2 agent/anti-IL-2 antibody complex. In an embodiment, the IL-2 agent comprises a conjugate.

In some aspects, the disclosure provides a pharmaceutical composition comprising an IL-2 agent described, and a pharmaceutically acceptable carrier. In some aspects, the disclosure provides a nucleic acid encoding an IL-2 agent described herein. In some aspects, the disclosure provides a vector (e.g., expression vector) comprising a nucleic acid encoding an IL-2 agent described herein. In some aspects, the disclosure provides a cell (e.g., isolated cell) comprising a nucleic acid encoding an IL-2 agent described herein or a vector (e.g., expression vector) comprising a nucleic acid encoding an IL-2 agent described herein.

In some aspects, the disclosure provides a method of producing an IL-2 agent, comprising culturing (e.g., maintaining) a cell comprising a nucleic acid encoding an IL-2 agent described herein or a vector (e.g., expression vector) comprising a nucleic acid encoding an IL-2 agent described herein under conditions permitting expression of the IL-2 agent. In an embodiment, the method further comprising obtaining the IL-2 agent. In an embodiment, the method further comprising purifying the IL-2 agent.

In some aspects, the disclosure provides a method of enhancing regulatory T cell (Treg) expansion, activity, survival, and/or proliferation, comprising contacting a Treg cell or a population of Treg cells (e.g., in vitro, ex vivo, or in vivo) or administering to a subject in need thereof an effective amount of an IL-2 agent described herein, or a pharmaceutical composition comprising the IL-2 agent. The IL-2 agent may, for example, comprise the amino acid substitutions H16L, V69A, Q74P and C125S, or the amino acid substitutions H16N, V69A, Q74P and C125S. In an embodiment, the IL-2 agent comprises amino acid substitutions H16L, V69A, Q74P and C125S.

In some aspects, the disclosure provides a method of selectively activating the IL-2 signaling pathway in regulatory T cells (Tregs), comprising contacting a Treg cell or a population of Treg cells (e.g., in vitro, ex vivo, or in vivo) or administering to a subject in need thereof an effective amount of an IL-2 agent described herein, or a pharmaceutical composition of comprising the IL-2 agent. The IL-2 agent may, for example, comprise the amino acid substitutions H16L, V69A, Q74P and C125S, or the amino acid substitutions H16N, V69A, Q74P and C125S. In an embodiment, the IL-2 agent comprises amino acid substitutions H16L, V69A, Q74P and C125S.

In some aspects, the disclosure provides a method of inducing immune tolerance in a subject in need thereof, comprising administering an effective amount of an IL-2 agent described herein, or a pharmaceutical composition comprising the IL-2 agent. The IL-2 agent may, for example, comprise the amino acid substitutions H16L, V69A, Q74P and C125S, or the amino acid substitutions H16N, V69A, Q74P and C125S. In an embodiment, the IL-2 agent comprises amino acid substitutions H16L, V69A, Q74P and C125S.

In some aspects, the disclosure provides a method of treating a subject having a disorder (e.g., a disorder described herein, e.g., an autoimmune disease, lupus nephritis, autoimmune hepatitis, nephrotic syndrome, or a cancer) comprising administering to the subject an effective amount of an IL-2 agent described herein, or a pharmaceutical composition comprising the IL-2 agent. The IL-2 agent may, for example, comprise the amino acid substitutions H16L, V69A, Q74P and C125S, or the amino acid substitutions H16N, V69A, Q74P and C125S. In an embodiment, the IL-2 agent comprises amino acid substitutions H16L, V69A, Q74P and C125S.

In some aspects, the disclosure provides an IL-2 agent or a composition for use in a method for the treatment of a subject having a disorder (e.g., a disorder described herein, e.g., an autoimmune disease, lupus nephritis, autoimmune hepatitis, nephrotic syndrome, or a cancer), the method comprising administering an IL-2 agent described herein, or a pharmaceutical composition comprising the IL-2 agent, to said subject. The IL-2 agent may, for example, comprise the amino acid substitutions H16L, V69A, Q74P and C125S, or the amino acid substitutions H16N, V69A, Q74P and C125S. In an embodiment, the IL-2 agent comprises amino acid substitutions H16L, V69A, Q74P and C125S.

In some aspects, the disclosure provides use of an IL-2 agent or a composition in the manufacture of a medicament in a method for the treatment of a subject having a disorder (e.g., a disorder described herein, e.g., an autoimmune disease, lupus nephritis, autoimmune hepatitis, nephrotic syndrome, or a cancer), the method comprising administering an IL-2 agent described herein, or a pharmaceutical composition comprising the IL-2 agent, to said subject. The IL-2 agent may, for example, comprise the amino acid substitutions H16L, V69A, Q74P and C125S, or the amino acid substitutions H16N, V69A, Q74P and C125S. In an embodiment, the IL-2 agent comprises amino acid substitutions H16L, V69A, Q74P and C125S.

In some aspects, the disclosure provides a kit comprising an IL-2 agent described herein, or a pharmaceutical composition comprising the IL-2 agent, and instructions for use. The IL-2 agent may, for example, comprise the amino acid substitutions H16L, V69A, Q74P and C125S, or the amino acid substitutions H16N, V69A, Q74P and C125S. In an embodiment, the IL-2 agent comprises amino acid substitutions H16L, V69A, Q74P and C125S.

In some aspects, the disclosure provides a container comprising an IL-2 agent described herein, or a pharmaceutical composition comprising the IL-2 agent. The IL-2 agent may, for example, comprise the amino acid substitutions H16L, V69A, Q74P and C125S, or the amino acid substitutions H16N, V69A, Q74P and C125S. In an embodiment, the IL-2 agent comprises amino acid substitutions H16L, V69A, Q74P and C125S.

BRIEF DESCRIPTION OF THE DRAWINGS

FIG. 9B, CD25+(high) T helper cells; FIG. 9C, NK cells; FIG. 9D CD8+ cytotoxic T cells) within human PBMCs after treatment with IL-2-Fc fusions containing mutations that reduce affinity for CD122/CD132 dimer, as determined by the extent of STAT5 phosphorylation. Cells were treated at indicated concentrations for 30 minutes with IL-2-Fc fusion protein containing V69A/Q74 mutations plus the indicated mutations, or with IL-2 N88D mutein fused to the C-terminus of a non-binding antibody (C-term N88D). Inactive IL-2-Fc fusion protein contains several mutations to reduce its IL-2 signaling activity (F42A, Y45A, L72G, N88D, V69A, Q74P). After treatment, cells were fixed with formaldehyde, permeabilized with cold methanol and stained for surface markers and for STAT5 transcription factor phosphorylated at Tyr694 (pSTAT5). Each population is identified based on gating as described in FIG. 8. Selected muteins were also evaluated for signaling activity on CD8+ cytotoxic T cells. These cells were gated as in FIG. 8, except using the CD8 surface marker in place of CD4. Median pSTAT5 level (median fluorescent intensity, MFI) is shown for each concentration of IL-2-Fc fusion protein tested in each cell population. Curve fitting performed using GraphPad Prism v5.03 with 4-parameter fit for log(agonist) vs response.

FIG. 10B, CD25+(high) T helper cells; FIG. 10C, NK cells) within human PBMCs after treatment with IL-2-Fc fusions containing mutations that reduce affinity for CD25. Human PBMCs were treated and analyzed as in FIG. 9. Median pSTAT5 level (MFI) is shown for each treatment in each population. To highlight the effect on $EC_{50}$, signaling within each mutein was normalized from 0 to 1 across the concentration range of IL-2-Fc treatment.

FIG. 11B, CD25+(high) T helper cells; FIG. 11C, NK cells) within human PBMCs after treatment with IL-2-Fc fusions containing paired mutations that reduce affinity for CD25 and CD122/CD132 dimer. Human PBMCs were treated and analyzed as in FIG. 9. IL-2-Fc fusion proteins comprising various IL-2 muteins are divided across top and bottom panels for clarity, as indicated. Median pSTAT5 level (MFI) is shown for each treatment in each population.

FIG. 12B is average of three mice per treatment group. FIG. 12C shows data from individual mice at the highest dose of each IL-2-Fc fusion protein tested.

FIGS. 13A-13C provide graphs illustrating a change in the level of CD4+T helper cells, measured as a percentage of total CD3+ T cells, in Tg32 mice treated with IL-2-Fc H16N (FIG. 13A) or C-term N88D (FIG. 13B). Mice were dosed as in FIG. 12. CD4+T helper cells were defined as CD45+CD3+CD4+ cells not CD25$^{high}$CD127−. Data in FIG. 13A and FIG. 13B is average of three mice per treatment group. FIG. 13C shows data from individual mice at the highest dose of each IL-2-Fc fusion protein tested.

FIG. 14B is average of three mice per treatment group. FIG. 14C shows data from individual mice at the highest dose of each IL-2-Fc fusion protein tested.

FIGS. 15A-15C provide graphs illustrating the change in the level of NK cells, measured as a percentage of total CD45+ lymphocytes, in Tg32 mice treated with IL-2-Fc H16N (FIG. 15A) or C-term N88D (FIG. 15B). Mice were dosed as in FIG. 12. NK cells were defined CD45+CD3−CD56+ cells. Data in FIG. 15A and FIG. 15B is average of three mice per treatment group. In each case the percentage NK cells is normalized within each mouse so that the pre-treatment value is 1. FIG. 15C shows data from individual mice at the highest dose of each IL-2-Fc fusion protein tested.

FIG. 16A) or inactivating mutations (42A, Y45A, L72G, N88D, V69A, Q74P; inactive; FIG. 16B) anchored to an anti-human Fc Octet tip. Binding kinetics were used to estimate the $K_D$ of each interaction.

FIGS. 17C-17D). The amount of IL-2-Fc or C-term N88D present at each time-point was measured using an ELISA assay with anti-IL-2 capture antibody (R&D Systems, AF-202) and anti-human Fc secondary antibody conjugated to horseradish peroxidase (Jackson ImmunoResearch 109-035-008). 100% of starting material was defined as the amount detectable in blood plasma 1 hour after injection. Note that the x-axis is categorical, not scaled by time.

FIG. 18A presents a schematic of the experimental design showing the various timepoints at which blood was drawn from the humanized mice dosed with the IL-2 Fc fusion polypeptides and control polypeptides. Flow cytometry was used to measure the various lymphocyte populations at each of the indicated timepoints. FIG. 18B presents the fold-expansion of T regulatory cells on the Y axis for each IL-2 Fc fusion polypeptide and its corresponding dose (low or high) depicted on the X axis. FIG. 18C presents the fold-expansion of T helper cells on the Y axis for each IL-2 Fc fusion polypeptide and its corresponding dose (low or high) depicted on the X axis. FIG. 18D presents the fold-expansion of NK cells on the Y axis for each IL-2 Fc fusion polypeptide and its corresponding dose (low or high) depicted on the X axis. The IL-2 Fc fusion polypeptides investigated, as depicted from left to right on the X axis of FIGS. 18B-18D, are as follows: the control monoclonal antibody (Motavizumab), inactive IL-2, the IL-2 mutein comprising the N88D mutation, wild type IL-2, IL-2 mutein comprising the mutations H16N/V69A/Q74P/C125S (SEQ ID NO: 1007), and IL-2 mutein comprising the mutations H16L/V69A/Q74P/C125S (SEQ ID NO:1008).

FIG. 19A presents the concentration of the IL-2 fusion proteins with the indicated combinations of mutations in the blood of mice on the Y axis over the days sampled post-dosing on the X axis. FIG. 19B presents a comparison of the half-life of an IL-2 fusion protein with the indicated combination of mutations in the IL-2 moiety with or without an additional mutation in the Fc region. The concentration of the indicated IL-2 fusion protein in the blood is presented on the Y axis over the days post-dosing on the X axis.

FIG. 21A presents the expansion of T regulatory cells expressed as fold change to baseline (baseline=pre-dose) over time, following four weekly injections of 100 µg/kg of the IL-2-Fc fusion protein. FIG. 21B presents the percentage of Ki67+T regulatory cells (measure of proliferating T regulatory cells) normalized to total T regulatory cells over time, following four weekly injections of 100 µg/kg of the IL-2-Fc fusion protein.

FIG. 22A presents the effects of the IL-2-Fc fusion protein on the number of NK cells over time, FIG. 22B presents the effects on cytotoxic T cells over time, FIG. 22C presents the effects on T helper cells over time, and FIG. 22D presents the effects on total T cells over time. Data are shown as fold-change to baseline (baseline=pre-dose) for each cell type.

FIG. 23A presents the proteinuria score as measured weekly in mice following treatment with 40 µg/kg of the exemplary IL-2-Fc fusion protein or the PBS vehicle control, which were administered every 3 days starting at 3 weeks of age and continuing until 18 weeks of age. The proteinuria score is shown on the Y-axis and the age of the mice in weeks is shown on the X-axis. FIG. 23B presents a series of graphs depicting the proteinuria score on the Y-axis in individual mice treated with the vehicle control or exemplary IL-2-Fc fusion protein, as shown on the X-axis. From left to right, the first panel depicts the proteinuria scores at 11 weeks of age, the center panel depicts the scores at 12 weeks of age, and the final panel depicts the scores at 13 weeks of age. FIG. 23C presents the glomerular lesions quantified on the Y-axis, at the end of the study (when mice reached 18 weeks of age) in individual mice treated with the vehicle control or exemplary IL-2-Fc fusion protein, as shown on the X-axis.

DETAILED DESCRIPTION

Figures 1A, 1B:
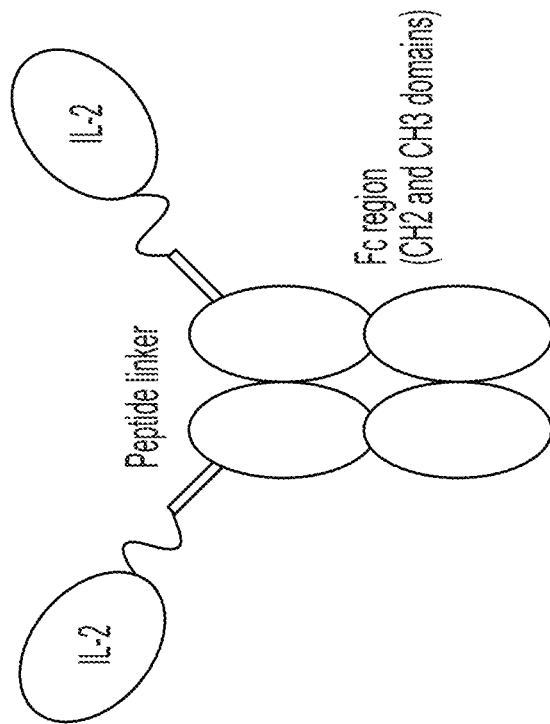
FIG. 1A provides a schematic illustrating the domain structure of an exemplary, non-limiting embodiment of an IL-2 agent provided for herein. The IL-2 agent comprises an IL-2 moiety or variant (also referred to herein as a "mutein"), a peptide linker, an Fc containing hinge sequence, and CH2 and CH3 domains of an antibody, as indicated.
FIG. 1B provides a depiction of an amino acid sequence of human IL-2 (SEQ ID NO: 1030) showing exemplary, non-limiting positions where, when mutated, results in an effect on IL-2 receptor binding and IL-2-mediated signaling activity in vitro and in vivo.

Disclosed herein are IL-2 agents (e.g., IL-2 variants, IL-2 fusion proteins, IL-2 complexes, or IL-2 conjugates) that have one or more structural and/or functional properties described herein. Advantageously, several of the IL-2 agents describe herein have one or more improved or desired properties, compared to an IL-2 agent comprising a wild-type IL-2. Without wishing to be bound by theory, it is believed that in an embodiment, the IL-2 agents described herein selectively enhance regulatory T cell (Treg) activity through the IL-2 pathway. Nucleic acid molecules encoding the IL-2 agents, expression vectors, host cells, compositions (e.g., pharmaceutical compositions), kits, containers, and methods for making the IL-2 agents, are also provided. The IL-2 agents and pharmaceutical compositions disclosed herein can be used (alone or in combination with other agents or therapeutic modalities) to treat, prevent, and/or diagnose disorders and conditions, e.g., disorders and conditions associated with T cell activity, e.g., a disorder or condition described herein (e.g., an autoimmune disorder described herein).

Immune response is typically controlled by recognition of specific foreign or self-antigens, communication between innate and adaptive immune pathways, crosstalk between B cells and T cells, and other factors. Some autoimmune diseases can be characterized by broad recognition of self-antigens. These diseases can be treated by therapies that broadly enhance the processes that protect self-antigens from attack by the immune system. Tregs are a type of T cell that recognizes self-antigens. In response to antigen stimulation they release immuno-suppressive cytokines and directly inhibit other T cells through cell-cell contacts. Impaired Treg activity contributes to a wide range of autoimmune disorders (e.g., too few cells, or cells that are less active). IL-2 is a cytokine that causes expansion and activation of many cell types, but Tregs are typically far more sensitive to IL-2 than are other cell types. Low dose IL-2 administration was shown to be associated with preferential, sustained Treg cell expansion in vivo and amelioration of the manifestations of chronic graft-vs-host disease (GVHD) in a substantial proportion of patients (Koreth et al., N Engl J Med. 2011; 365(22): 2055-2066). In an embodiment, the IL-2 agents described herein provide a long-lived immunomodulator (e.g., immunosuppressant) for a number of disorders (e.g., autoimmune indications).

The present disclosure is based, at least in part, on the discovery that IL-2 agents comprising a human IL-2 polypeptide with specific combinations of amino acid substitutions described herein can have advantageous technical effects, e.g., increasing the stability of the IL-2 agent and/or providing the selective activation of regulatory T cells. The IL-2 agents described herein typically requires CD25 for efficient signaling through IL-2 receptors, making it highly selective for Tregs. IL-2 signaling promotes Treg suppressor functions and drives proliferation. Without wishing to be bound by theory, it is believed that Tregs activated by the IL-2 agents described herein can dampen autoimmune activity through varied mechanisms.

In an embodiment, the IL-2 agents described herein were found to selectively bind to and activate regulatory T cells with a concomitant lack of effect on other immune cell types (e.g., $CD25^{high}$ T cells and NK cells). Without wishing to be bound by theory, it is believed that in an embodiment, the amino acid substitutions described herein both promote the ability of the IL-2 agent to maintain an active conformation and modulate the binding affinity of the IL-2 agent for the dimeric receptor comprising IL-2R13 (CD122) and IL-2Rγ (CD132), and the trimeric receptor comprising IL-2Rα (CD25) along with CD122 and CD132. In an embodiment, the IL-2 agents described herein have an affinity that is optimal for selectively binding to and activating IL-2 signaling in regulatory T cells, resulting in selective regulatory T cell activation and expansion both in vitro and in vivo. Without wishing to be bound by theory, it is believed that in an embodiment, binding of IL-2 to IL-2 receptors is a major route of clearance of IL-2 in vivo. For example, the IL-2 agents described herein, having a reduced affinity for dimeric and trimeric IL-2 receptors showed an extended half-life, indicating that lowering the affinity for IL-2 receptors decreases the clearance of the IL-2 agent in vivo. The IL-2 agents described herein, such as those having amino acid substitutions that increase stability and a reduce affinity for IL-2 receptors, can selectively activate regulatory T cells and exhibit an increased in half-life in vivo. The IL-2 agents described herein, such as those having mutations that prevent CD25 binding, can have improved half-life in vivo. In an embodiment, the IL-2 agent does not promote, or does not substantially promote, expansion, activation, survival, and/or proliferation of T effector cells and/or NK cells in vitro and/or in vivo. Without wishing to be bound by theory, it is believed that in an embodiment, the IL-2 agents described herein can have larger therapeutic window than low dose IL-2.

There are various technical effects associated with the presence of the particular sets of mutations described herein, for example, a set of mutations comprising an amino acid substitution at position H16, in combination with amino acid substitutions at positions V69, Q74, and C125 (e.g., H16L, V69A, Q74P, and C125S). Without wishing to be bound by theory, it is believed that in an embodiment, an IL-2 agent (e.g., IL-2 variant or IL-2 fusion protein) comprising H16L, V69A, Q74P, and C125S is significantly stable, e.g., due to the presence of stabilizing V69A and Q74P mutations. For example, it was unexpectedly discovered that the V69A and Q74P substitutions do not substantially increase (or essentially reduce) the binding affinity of the IL-2 agent for CD25, but rather stabilize the IL-2 agent in an active conformation sufficient for binding to CD25. Without wishing to be bound by theory, it is also believed that in an embodiment, an IL-2 agent comprising the aforesaid mutations has reduced binding affinity for CD122 and/or CD132, which increases the potency and selectivity of the IL-2 agent for regulatory T cells (Treg) compared to other T cell types. Therefore, an IL-2 agent comprising these mutations is typically stable and selectively activates regulatory T cells (Treg). Without wishing to be bound by theory, it is further believed that in an embodiment, an IL-2 agent comprising the aforesaid mutations has reduced or decreased binding capacity and/or binding affinity for CD25, which improves the lifetime of the IL-2 agent. Without wishing to be bound by theory, it is also believed that in an embodiment, an IL-2 agent comprising these mutations does not substantially promote expansion, activation, survival, and/or proliferation of T effector cells and/or natural killer (NK) cells in vitro and/or in vivo. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 agent comprising the aforesaid mutations particularly suitable for treating disorders and conditions arising from abnormal immune responses, such as autoimmune diseases.

Thus, in an embodiment, an IL-2 agent (e.g., IL-2 variant or IL-2 fusion protein) comprising an amino acid substitution at position H16 in combination with amino acid substitutions at positions V69, Q74, and C125 (e.g., H16L, V69A, Q74P, and C125S), has inter alia one or more (e.g., 2, 3, 4, 5, 6, 7, or all) of the following properties relative to a wild-type IL-2 or a reference IL-2 agent that does not comprise the amino acid substitutions:

(i) enhanced or increased stability in vitro or in vivo;
 (ii) reduced or decreased binding capacity and/or binding affinity for human CD122 in vitro and/or in vivo;
 (iii) reduced or decreased binding capacity and/or binding affinity for human CD132 in vitro and/or in vivo;
 (iv) reduced or decreased affinity of the IL-2 agent for the heterodimeric IL-2 receptor composed of human CD122 and human CD132 (i.e. human CD122/CD132 heterodimer) in vitro and/or in vivo;
 (v) reduced or decreased (e.g., moderately reduced or decreased) binding capacity and/or binding affinity for human CD25 in vitro and/or in vivo;
 (vi) selective binding to regulatory T cells (e.g. Foxp3+ T cells);
 (vii) selective activation of the IL-2 signaling pathway in T regulatory cells (Tregs) in vitro or in vivo; or
 (viii) enhanced or increased ability to induce or promote Treg expansion, activity, survival and/or proliferation.

Definitions

As used herein, the articles "a" and "an" refer to one or to more than one (e.g., to at least one) of the grammatical object of the article.

The term "or" is used herein to mean, and is used interchangeably with, the term "and/or", unless context clearly indicates otherwise.

"About" and "approximately" shall generally mean an acceptable degree of error for the quantity measured given the nature or precision of the measurements. Exemplary degrees of error are within 20 percent (%), typically, within 10%, and more typically, within 5% of a given value or range of values. When "about" or "approximately" is present before a series of numbers or a range, it is understood that "about" or "approximately" can modify each of the numbers in the series or range. Similarly, when "at least," "more than," "no more than," "less than," "no less than," or "within" is present before a series of numbers or a range, it is understood that "at least," "more than," "no more than," "less than," "no less than," or "within" can modify each of the numbers in the series or range. As used herein, ranges include both the upper and lower limit.

The compositions and methods disclosed herein encompass polypeptides and nucleic acids having the sequences specified, or sequences substantially identical or similar thereto, e.g., sequences at least 85%, 90%, 95% identical or higher to the sequence specified.

In the context of an amino acid sequence, the term "substantially identical" is used herein to refer to a first amino acid that contains a sufficient or minimum number of amino acid residues that are i) identical to, or ii) conservative substitutions of aligned amino acid residues in a second amino acid sequence such that the first and second amino acid sequences can have a common structural domain and/or common functional activity. For example, amino acid sequences that contain a common structural domain having at least about 85%, 90%, 91%, 92%, 93%, 94%, 95%, 96%, 97%, 98% or 99% identity to a reference sequence, e.g., a sequence provided herein.

In the context of nucleotide sequence, the term "substantially identical" is used herein to refer to a first nucleic acid sequence that contains a sufficient or minimum number of nucleotides that are identical to aligned nucleotides in a second nucleic acid sequence such that the first and second nucleotide sequences encode a polypeptide having common functional activity, or encode a common structural polypeptide domain or a common functional polypeptide activity. For example, nucleotide sequences having at least about 85%, 90%, 91%, 92%, 93%, 94%, 95%, 96%, 97%, 98% or 99% identity to a reference sequence, e.g., a sequence provided herein.

The term "functional variant" refers polypeptides that have a substantially identical amino acid sequence to the naturally-occurring sequence, or are encoded by a substantially identical nucleotide sequence, and are capable of having one or more activities of the naturally-occurring sequence.

Calculations of homology or sequence identity between sequences (the terms are used interchangeably herein) are performed as follows.

To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In a typical embodiment, the length of a reference sequence aligned for comparison purposes is at least 30%, e.g., at least 40%, 50%, 60%, e.g., at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position.

The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In an embodiment, the percent identity between two amino acid sequences is determined using the Needleman and Wunsch ((1970) *J. Mol. Biol.* 48:444-453) algorithm which has been incorporated into the GAP program in the GCG software package (available at www.gcg.com), using either a Blossum 62 matrix or a PAM250 matrix, and a gap weight of 16, 14, 12, 10, 8, 6, or 4 and a length weight of 1, 2, 3, 4, 5, or 6. In certain embodiments, the percent identity between two nucleotide sequences is determined using the GAP program in the GCG software package (available at www.gcg.com), using a NWSgapdna.CMP matrix and a gap weight of 40, 50, 60, 70, or 80 and a length weight of 1, 2, 3, 4, 5, or 6. One suitable set of parameters (and the one that should be used unless otherwise specified) are a Blossum 62 scoring matrix with a gap penalty of 12, a gap extend penalty of 4, and a frameshift gap penalty of 5.

The percent identity between two amino acid or nucleotide sequences can be determined using the algorithm of E. Meyers and W. Miller ((1989) CABIOS, 4:11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al. (1990) *J. Mol. Biol.* 215: 403-10. BLAST nucleotide searches can be performed with the NBLAST program, score=100, wordlength=12 to obtain nucleotide sequences homologous to a nucleic acid as described herein. BLAST protein searches can be performed with the XBLAST program, score=50, wordlength=3 to obtain amino acid sequences homologous to protein molecules described herein. To obtain gapped alignments for comparison purposes, Gapped BLAST can be utilized as described in Altschul et al., (1997) *Nucleic Acids Res.* 25:3389-3402. When utilizing BLAST and gapped BLAST programs, the default parameters of the respective programs (e.g., XBLAST and NBLAST) can be used. See www.ncbi.nlm.nih.gov.

As used herein, the term "hybridizes under low stringency, medium stringency, high stringency, or very high stringency conditions" describes conditions for hybridization and washing. Guidance for performing hybridization reactions can be found in *Current Protocols in Molecular Biology*, John Wiley & Sons, N.Y. (1989), 6.3.1-6.3.6, which is incorporated by reference. Aqueous and nonaqueous methods are described in that reference and either can be used. Specific hybridization conditions referred to herein are as follows: 1) low stringency hybridization conditions in 6× sodium chloride/sodium citrate (SSC) at about 45° C., followed by two washes in 0.2×SSC, 0.1% SDS at least at 50° C. (the temperature of the washes can be increased to 55° C. for low stringency conditions); 2) medium stringency hybridization conditions in 6×SSC at about 45° C., followed by one or more washes in 0.2×SSC, 0.1% SDS at 60° C.; 3) high stringency hybridization conditions in 6×SSC at about 45° C., followed by one or more washes in 0.2×SSC, 0.1% SDS at 65° C.; and preferably 4) very high stringency hybridization conditions are 0.5M sodium phosphate, 7% SDS at 65° C., followed by one or more washes at 0.2×SSC, 1% SDS at 65° C. Very high stringency conditions 4) are suitable conditions and the ones that should be used unless otherwise specified.

It is understood that the molecules described herein may have additional conservative or non-essential amino acid substitutions, which do not have a substantial effect on their functions.

The term "amino acid" is intended to embrace all molecules, whether natural or synthetic, which include both an amino functionality and an acid functionality and capable of being included in a polymer of naturally-occurring amino acids. Exemplary amino acids include naturally-occurring amino acids; analogs, derivatives and congeners thereof; amino acid analogs having variant side chains; and all stereoisomers of any of any of the foregoing. As used herein the term "amino acid" includes both the D- or L-optical isomers and peptidomimetics.

A "conservative amino acid substitution" is one in which the amino acid residue is replaced with an amino acid residue having a similar side chain. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine).

The terms "polypeptide," "peptide" and "protein" (if single chain) are used interchangeably herein to refer to polymers of amino acids of any length. The polymer may be linear or branched, it may comprise modified amino acids, and it may be interrupted by non-amino acids. The terms also encompass an amino acid polymer that has been modified; for example, disulfide bond formation, glycosylation, lipidation, acetylation, phosphorylation, or any other manipulation, such as conjugation with a labeling component. The polypeptide can be isolated from natural sources, can be a produced by recombinant techniques from a eukaryotic or prokaryotic host, or can be a product of synthetic procedures.

As recognized by those skilled in the art, protein fragments, functional protein domains, and homologous proteins are also considered to be within the scope of this invention. For example, provided herein is any protein fragment of a reference protein (meaning a polypeptide sequence at least one amino acid residue shorter than a reference polypeptide sequence but otherwise identical) 5, 10, 15, 20, 25, 30, 35, 40, 45, 50, 55, 60, 70, 80, 90, 100, or greater than 100 amino acids in length In another example, any protein that includes a stretch of about 20, about 30, about 40, about 50, or about 100 amino acids which are about 40%, about 50%, about 60%, about 70%, about 80%, about 90%, about 95%, about 98%, or about 100% identical to any of the sequences described herein can be utilized in accordance with the invention. In an embodiment, a protein sequence to be utilized in accordance with the disclosure includes 2, 3, 4, 5, 6, 7, 8, 9, 10, or more mutations as shown in any of the sequences provided or referenced herein.

The terms "nucleic acid," "nucleic acid sequence," "nucleotide sequence," or "polynucleotide sequence," and "polynucleotide" are used interchangeably. They refer to a polymeric form of nucleotides of any length, either deoxyribonucleotides or ribonucleotides, or analogs thereof. The polynucleotide may be either single-stranded or double-stranded, and if single-stranded may be the coding strand or non-coding (antisense) strand. A polynucleotide may comprise modified nucleotides, such as methylated nucleotides and nucleotide analogs. The sequence of nucleotides may be interrupted by non-nucleotide components. A polynucleotide may be further modified after polymerization, such as by conjugation with a labeling component. The nucleic acid may be a recombinant polynucleotide, or a polynucleotide of genomic, cDNA, semisynthetic, or synthetic origin which either does not occur in nature or is linked to another polynucleotide in a non-natural arrangement.

The term "isolated," as used herein, refers to material that is removed from its original or native environment (e.g., the natural environment if it is naturally occurring). For example, a naturally-occurring polynucleotide or polypeptide present in a living animal is not isolated, but the same polynucleotide or polypeptide, separated by human intervention from some or all of the co-existing materials in the natural system, is isolated. Such polynucleotides could be part of a vector and/or such polynucleotides or polypeptides could be part of a composition, and still be isolated in that such vector or composition is not part of the environment in which it is found in nature.

As used herein, the term "treat," a disorder, e.g., a myeloma, means that a subject (e.g., a human) who has a disorder, e.g., a myeloma, and/or experiences a symptom of a disorder, e.g., a myeloma, will, in an embodiment, suffer less a severe symptom and/or recover faster when an antibody molecule is administered than if the antibody molecule were never administered. In an embodiment, when a myeloma is treated, a bone marrow biopsy will show fewer clonal plasma cells, after effective treatment for myeloma. For example, a diagnostic assay will detect fewer clonal plasma cells in a biological sample of a subject after administration of an antibody molecule described herein for the effective treatment of a myeloma. Other assays, urine tests, or blood tests, can also be used to monitor treatment in a patient, or to detect the presence, e.g., decreased presence (or absence), of a symptom of a myeloma, after treatment of a myeloma in the subject. In an embodiment, when a myeloma is treated, the level of β2 microglobulin (β2M) in serum or urine will be decreased, after effective treatment for myeloma. Treatment can, e.g., partially or completely, alleviate, ameliorate, relieve, inhibit, or reduce the severity of, and/or reduce incidence, and optionally, delay onset of, one or more manifestations of the effects or symptoms, features, and/or causes of a disorder, e.g., a myeloma. In an embodiment, treatment is of a subject who does not exhibit certain signs of a disorder, e.g., a myeloma, and/or of a subject who exhibits only early signs of a disorder, e.g., nephropathy. In an embodiment, treatment is of a subject who exhibits one or more established signs of a disorder, e.g., a myeloma. In an embodiment, treatment is of a subject diagnosed as suffering from a disorder, e.g., a myeloma.

As used herein, the term "prevent," a disorder, e.g., a myeloma, means that a subject (e.g., a human) is less likely to have the disorder, e.g., a myeloma, if the subject receives the antibody molecule.

Various aspects of the compositions and methods herein are described in further detail below. Additional definitions are set out throughout the specification.

IL-2 Agents

The present disclosure provides IL-2 agents, including, but not limited to, IL-2 variants, IL-2 fusion proteins, IL-2 complexes, and IL-2 conjugates. For example, the IL-2 agents described herein can have one or more structural and/or functional properties described herein. In an embodiment, the IL-2 agent comprises an IL-2 variant comprising one or more amino acid alterations (e.g., substitutions) described herein. In an embodiment, the IL-2 agent comprises an IL-2 variant comprising one or more amino acid alterations (e.g., substitutions) described in Table 9. In an embodiment, the IL-2 agent comprises an IL-2 variant comprising an amino acid sequence described in Table 9, or a portion thereof. In an embodiment, the IL-2 agent, or a portion thereof, is encoded by a nucleic acid comprising a nucleotide sequence described herein, e.g., in Table 10. The one or more amino acid alterations (e.g., substitutions), alone or in combination, may confer one or more desired biological properties described herein. In an embodiment, the IL-2 agent can modulate (e.g. increase) Treg proliferation, survival, activation and/or function. In an embodiment, the modulation is selective or specific for the Tregs. For example, the IL-2 agent is capable of modulating the activity in Tregs but has limited or lacks the ability to promote the activity in non-regulatory T cells. In an embodiment, the IL-2 agent comprises a polypeptide (sometime referred to herein as "IL-2 polypeptide agent").

IL-2 Variants

In an embodiment, the IL-2 agent comprises an IL-2 variant, e.g., an IL-2 variant described herein.

In an embodiment, the IL-2 variant comprises an IL-2 polypeptide (e.g., a human IL-2 polypeptide) described herein, or a functional fragment thereof. In an embodiment, the IL-2 variant comprises one or more amino acid alterations (e.g., substitutions) described in Table 9. In an embodiment, the IL-2 variant comprises, or consists of, an amino acid sequence described in Table 9, or a functional fragment thereof. In an embodiment, the IL-2 variant is encoded by a nucleic acid comprising a nucleotide sequence described herein, e.g., in Table 10.

Without wishing to be bound by theory, it is believed that in an embodiment, the IL-2 variants described herein, which have reduced human CD25 and/or reduced human CD122/CD132 binding affinity relative to a wild-type human IL-2 or a reference IL-2 variant, can have improved potency and/or selectivity for binding to and activating regulatory T cells (Tregs) than wild type IL-2 or other IL-2 variants. The IL-2 variants described herein can be identified, e.g., by screening a library of mutated IL-2 polypeptides to identify IL-2 variants having a binding affinity for human CD25 and/or human CD122/CD132 in a desired range.

In an embodiment, the IL-2 variant has one or more (e.g., 2, 3, 4, 5, 6, 7, 8, 9, 10, 11, 12, or more) properties described herein, e.g., different and/or improved properties, relative to a wild-type IL-2 or a reference IL-2 variant. In an embodiment, the IL-2 variant comprises one or more (e.g., 2, 3, 4, 5, 6, 7, 8, 9, 10, or more) amino acid alterations (e.g., substitutions) that provide different and/or improved properties, relative to a wild-type IL-2 or a reference IL-2 variant. In an embodiment, the IL-2 variant has one or more (e.g., 2, 3, 4, 5, 6, 7, 8, 9, 10, 11, 12, or all) of the following different and/or improved properties (e.g., as determined by an assay described herein), relative to a wild-type IL-2 or a reference IL-2 variant:

i) altered (e.g., enhanced or increased) expression in vitro and/or in vivo;

ii) altered (e.g., reduced or decreased) aggregation in vitro and/or in vivo;

iii) altered (e.g., enhanced or increased) stability in vitro and/or in vivo;

iv) altered (e.g., enhanced or increased) half-life in vitro and/or in vivo;

v) altered (e.g., reduced or decreased) turnover and/or clearance in vivo;

vi) altered (e.g., reduced or decreased) susceptibility to proteolysis in vitro and/or in vivo;

vii) altered (e.g., enhanced or increased) resistance to proteolysis in vitro and/or in vivo;

viii) altered (e.g., reduced or decreased) binding capacity and/or binding affinity for human CD25 in vitro and/or in vivo;

ix) altered (e.g., reduced or decreased) binding capacity and/or binding affinity for human CD132 in vitro and/or in vivo;

x) altered (e.g., reduced or decreased) binding capacity and/or binding affinity for the dimeric IL-2 receptor comprising human CD122 and human CD132 in vitro and/or in vivo;

xi) altered (e.g., enhanced, increased, reduced, decreased, and/or selective) binding to Tregs in vitro and/or in vivo;

xii) altered (e.g., enhanced, increased, reduced, decreased, and/or selective) activation of the IL-2 signaling pathway in Tregs in vitro and/or in vivo;

xiii) altered (e.g., enhanced, increased, reduced, decreased, and/or selective) ability to induce or promote Treg expansion, activity, survival, and/or proliferation in vitro and/or in vivo.

In an embodiment, the IL-2 variant has altered (e.g., enhanced or increased) expression in vitro and/or in vivo, relative to a wild-type IL-2 or a reference IL-2 variant. In an embodiment, the IL-2 variant has enhanced or increased expression (e.g., in a bacterial or mammalian cell) relative to a wild-type IL-2. In an embodiment, the IL-2 variant has enhanced or increased expression (e.g., in bacterial or mammalian cell) relative to a reference IL-2 variant. In an embodiment, the expression of the IL-2 variant is increased by about 1%, 5%, 10%, 20%, 30%, 40%, 50%, 60%, 70%, 80%, 90%, 95%, or about 100%, or more. In an embodiment, the expression of the IL-2 variant is increased by about 0.5-fold, 1-fold, 2-fold, 3-fold, 4-fold, 5-fold, 6-fold, 7-fold, 8-fold, 9-fold, or about 10-fold, or more. In an embodiment, the IL-2 variant expresses at a higher or increased level in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more e.g., relative to an IL-2 agent comprising a wild-type IL-2 or an IL-2 agent comprising a reference IL-2 variant e.g., as determined by an assay of protein concentration. In an embodiment, the IL-2 variant expresses at a higher or increased level, e.g., increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant e.g., as determined by an assay of protein concentration.

In an embodiment, the IL-2 variant has altered (e.g., reduced or decreased) aggregation in vitro and/or in vivo, relative to a wild-type IL-2 or a reference IL-2 variant. In an embodiment, the IL-2 variant has reduced or decreased aggregation relative to a wild type IL-2. In an embodiment, the IL-2 variant has reduced or decreased aggregation relative to a reference IL-2 variant. In an embodiment, the aggregation of the IL-2 variant is decreased by about 1%, 5%, 10%, 20%, 30%, 40%, 50%, 60%, 70%, 80%, 90%, 95%, or about 100%, or more. In an embodiment, the aggregation of the IL-2 variant is decreased by about 0.5-fold, 1-fold, 2-fold, 3-fold, 4-fold, 5-fold, 6-fold, 7-fold, 8-fold, 9-fold, or about 10-fold, or more. In an embodiment, an IL-2 agent comprising an IL-2 variant described herein aggregates at lower or decreased level in vitro and/or in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more e.g., relative to an IL-2 agent comprising a wild-type IL-2 or an IL-2 agent comprising a reference IL-2 variant e.g., as determined by melting temperature analysis (e.g., using fluorimetry), dynamic light scattering, and/or size-exclusion chromatography. In an embodiment, an IL-2 agent comprising an IL-2 variant described herein aggregates at lower or decreased level, e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant, e.g., as determined by melting temperature analysis (e.g., using fluorimetry), dynamic light scattering, and/or size-exclusion chromatography.

In an embodiment, the IL-2 variant has altered (e.g., enhanced or increased) stability in vitro and/or in vivo, relative to a wild-type IL-2 or a reference IL-2 variant. In an embodiment, the IL-2 variant has enhanced or increased stability relative to a wild-type IL-2. In an embodiment, the IL-2 variant has enhanced or increased stability relative to a reference IL-2 variant. In an embodiment, the stability of the IL-2 variant is increased by about 1%, 5%, 10%, 20%, 30%, 40%, 50%, 60%, 70%, 80%, 90%, 95%, or about 100%, or more. In an embodiment, the stability of the IL-2 variant is increased by about 0.5-fold, 1-fold, 2-fold, 3-fold, 4-fold, 5-fold, 6-fold, 7-fold, 8-fold, 9-fold, or about 10-fold, or more. In an embodiment, an IL-2 agent comprising an IL-variant described herein has enhanced or increased stability in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant, e.g., as determined by yeast surface display, circular dichroism or related spectroscopic techniques, and/or melting temperature analysis (e.g., using fluorimetry).

In an embodiment, the IL-2 variant has altered (e.g., enhanced or increased) half-life in vitro and/or in vivo, relative to a wild-type IL-2 or a reference IL-2 variant. In an embodiment, the IL-2 variant has enhanced or increased half-life relative to a wild-type IL-2. In an embodiment, the IL-2 variant has enhanced or increased half-life relative to a reference IL-2 variant. In an embodiment, the half-life of the IL-2 variant is increased by about 1%, 5%, 10%, 20%, 30%, 40%, 50%, 60%, 70%, 80%, 90%, 95%, or about 100%, or more. In an embodiment, the half-life of the IL-2 variant is increased by about 0.5-fold, 1-fold, 2-fold, 3-fold, 4-fold, 5-fold, 6-fold, 7-fold, 8-fold, 9-fold, or about 10-fold, or more. In an embodiment, an IL-2 agent comprising an IL-2 variant described herein has enhanced or increased half-life in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., greater than about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant, e.g., as determined by ELISA, flow cytometry, and/or mass spectrometry.

In an embodiment, the IL-2 variant has altered (e.g., reduced or decreased) turnover in vitro and/or in vivo, relative to a wild-type IL-2 or a reference IL-2 variant. In an embodiment, the IL-2 variant has reduced or decreased turnover relative to a wild-type IL-2. In an embodiment, the IL-2 variant has reduced or decreased turnover relative to a reference IL-2 variant. In an embodiment, the turnover of the IL-2 variant is decreased by about 1%, 5%, 10%, 20%, 30%, 40%, 50%, 60%, 70%, 80%, 90%, 95%, or about 100%, or more. In an embodiment, the turnover of the IL-2 variant is decreased by about 0.5-fold, 1-fold, 2-fold, 3-fold, 4-fold, 5-fold, 6-fold, 7-fold, 8-fold, 9-fold, about 10-fold, or more. In an embodiment, an IL-2 agent comprising an IL-2 variant described herein has a lower, reduced or decreased rate or level of turnover and/or clearance in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant, e.g., as determined by ELISA, flow cytometry, and/or mass spectrometry.

In an embodiment, the IL-2 has altered (e.g., reduced or decreased) susceptibility to proteolysis in vitro and/or in vivo, relative to a wild-type IL-2 or a reference IL-2 variant. In an embodiment, the IL-2 variant has reduced or decreased susceptibility to proteolysis relative to IL-2 (e.g., wild type human IL-2). In an embodiment, the IL-2 variant has reduced or decreased susceptibility to proteolysis relative to a reference IL-2 variant. In an embodiment, the susceptibility to proteolysis of the IL-2 variant is decreased by about 1%, 5%, 10%, 20%, 30%, 40%, 50%, 60%, 70%, 80%, 90%, 95%, or about 100%, or more. In an embodiment, the susceptibility to proteolysis of the IL-2 variant is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has altered (e.g., enhanced or increased) resistance to proteolysis in vitro and/or in vivo, relative to a wild-type IL-2 or a reference IL-2 variant. In an embodiment, the IL-2 variant has enhanced or increased resistance to proteolysis relative to a wild-type IL-2. In an embodiment, the IL-2 variant has enhanced or increased resistance to proteolysis relative to a reference IL-2 variant. In an embodiment, the resistance to proteolysis of the IL-2 variant is increased by about 1%, 5%, 10%, 20%, 30%, 40%, 50%, 60%, 70%, 80%, 90%, 95%, or about 100%, or more. In an embodiment, the resistance to proteolysis of the IL-2 variant is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has altered (e.g., reduced or decreased) binding capacity and/or binding affinity for human CD25 in vitro and/or in vivo, relative to a wild-type IL-2 or a reference IL-2 variant. In an embodiment, the IL-2 variant has reduced or decreased binding capacity and/or binding affinity for human CD25 relative to a wild-type human IL-2). In an embodiment, the IL-2 variant has reduced or decreased binding capacity and/or binding affinity for human CD25 relative to a reference IL-2 variant. In an embodiment, the binding capacity and/or binding affinity of the IL-2 variant for human CD25 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 variant for human CD25 is decreased by about 0.5-fold, 1-fold, 2-fold, 3-fold, 4-fold, 5-fold, 6-fold, 7-fold, 8-fold, 9-fold, or about 10-fold, or more. In an embodiment, an IL-2 agent comprising an IL-2 variant described herein has reduced or decreased binding affinity for CD25 (e.g., human CD25), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant e.g., as determined by yeast surface display, surface plasmon resonance (e.g. Biacore) and/or bio-layer interferometry (e.g. Octet binding).

In an embodiment, the IL-2 variant binds to CD25 (e.g., human CD25) with low affinity, e.g., with a dissociation constant ($K_D$) of about 5-500 pM, e.g., about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, or e.g., about 10 to about 400 pM, about 20 to about 300 pM, about 50 to about 200 pM, about 100 to about 150 pM, about 5 to about 10 pM, e.g., about 10 to about 20 pM, about 20 to about 30 pM, or about 30 to about 40 pM, e.g., about 40 to about 50 pM, about 50 to about 60 pM, about 60 to about 70 pM, about 70 to about 80 pM, about 80 to about 90 pM, about 90 to about 100 pM, about 100 to about 110 pM, about 110 to about 120 pM, about 120 to about 130 pM, about 130 to about 140 pM about 140 to about 150 pM, about 150 to about 200 pM, about 200 to about 250 pM, about 250 to about 300 pM, about 300 to about 350 pM, about 350 to about 400 pM, about 400 to about 500 pM, or e.g., greater than about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, e.g. as determined by yeast surface display, surface plasmon resonance (e.g. Biacore) and/or biolayer interferometry (e.g. Octet binding).

In an embodiment, the IL-2 variant binds to CD25 (e.g., human CD25) with low affinity, e.g., with a dissociation constant ($K_D$) of about 0.1-10 nM, e.g., about 0.1, about 0.2, about 0.3, about 0.4, about 0.5, about 0.6, about 0.7, about 0.8, about 0.9, about 1, about 1.5, about 2, about 2.5, about 3, about 3.5, about 4, about 4.5, about 5, about 6, about 7, about 8, about 9, or about 10 nM, or e.g., about 0.2 to about 5 nM, about 0.5 to about 2 nM, about 1 to 1.5 nM, about 0.1 to about 0.2 nM, e.g., about 0.2 to about 0.3 nM, about 0.3 to about 0.4 nM, or about 0.4 to about 0.5 nM, e.g., about 0.5 to about 0.6 nM, about 0.6 to about 0.7 nM, about 0.7 to about 0.8 nM, about 0.8 to about 0.9 nM, about 0.9 to about 1 nM, about 1 to about 1.5 nM, about 1.5 to about 2 nM, about 2.5 to about 3 nM, about 3.5 to about 4 nM, about 4 to about 4.5 nM, about 4.5 to about 5 nM, about 5 to about 6 nM, about 6 to about 7 nM, about 7 to about 8 nM, about 8 to about 9 nM, or about 9 to about 10 nM, or e.g., greater than about 0.1, about 0.2. about 0.3, about 0.4, about 0.5, about 0.6, about 0.7, about 0.8, about 0.9, about 1, about 2, about 3, about 4, about 5, about 6, about 7, about 8, about 9, or about 10 nM, e.g., as determined by surface plasmon resonance (e.g. Biacore) and/or bio-layer interferometry (e.g., Octet binding).

In an embodiment, the IL-2 variant has altered (e.g., reduced or decreased) binding capacity and/or binding affinity for human CD132 in vitro and/or in vivo, relative to a wild-type IL-2 or a reference IL-2 variant. In an embodiment, the IL-2 variant has reduced or decreased binding capacity and/or binding affinity for human CD132 relative to a wild-type IL-2. In an embodiment, the IL-2 variant has reduced or decreased binding capacity and/or binding affinity for human CD132 relative to a reference IL-2 variant. In an embodiment, the binding capacity and/or binding affinity of the IL-2 variant for human CD132 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 variant for human CD132 is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has altered (e.g., reduced or decreased) binding capacity and/or binding affinity for the human dimeric IL-2 receptor comprising human CD122 and human CD132 in vitro and/or in vivo, relative to a wild-type IL-2 or a reference IL-2 variant. In an embodiment, the IL-2 variant has reduced or decreased binding capacity and/or binding affinity for the human dimeric IL-2 receptor comprising human CD122 and human CD132 relative to a wild-type IL-2. In an embodiment, the IL-2 variant has reduced or decreased binding capacity and/or binding affinity for the human dimeric IL-2 receptor comprising human CD122 and human CD132 relative to a reference IL-2 variant. In an embodiment, the binding capacity and/or binding affinity of the IL-2 variant for the human dimeric IL-2 receptor comprising human CD122 and human CD132 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 variant for the human dimeric IL-2 receptor comprising human CD122 and human CD132 is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has reduced or decreased binding affinity for CD122/CD132 heterodimer (e.g., human CD122/CD132 heterodimer), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant e.g., as determined by yeast surface display, surface plasmon resonance (e.g. Biacore) and/or bio-layer interferometry (e.g. Octet binding).

In an embodiment, the IL-2 variant binds to CD122/CD132 heterodimer (e.g., human CD122/CD132 heterodimer) with low affinity, e.g., with a dissociation constant (KD) of about 0.2-20 nM, e.g., about 0.2, about 0.3, about 0.4, about 0.5, about 0.6, about 0.7, about 0.8, about 0.9, about 1, about 1.1, about 1.2, about 1.3, about 1.4. about 1.5, about 2, about 3, about 4, about 5, about 6, about 7, about 8, about 9, about 10, about 11, about 12, about 13, about 14, about 15, about 16, about 17, about 18, or about 20 nM, or e.g., about 0.5 to about 15 nM, about 1 to about 10 nM, about 2 to about 5 nM, about 0.2 to about 0.3 nM, about 0.3 to about 0.4 nM, about 0.4 to about 0.5 nM, about 0.5 to about 0.6 nM, about 0.6 to about 0.7 nM, about 0.7 to about 0.8 nM, about 0.8 to about 0.9 nM, about 0.9 to about 1 nM, about 1 to about 1.1 nM, about 1.1 to about 1.2 nM, about 1.2 to about 1.3 nM, about 1.3 to about 1.4 nM, about 1.4 to about 1.5 nM, about 1.5 to about 2 nM, about 2 to about 3 nM, about 3 to about 4 nM, about 4 to about 5 nM, about 5 to about 6 nM, about 6 to about 7 nM, about 7 to about 8 nM, about 8 to about 9 nM, about 9 to about 10 nM, about 10 to about 11 nM, about 11 to about 12 nM, about 12 to about 13 nM, about 13 to about 14 nM, about 14 to about 15 nM, about 15 to about 16 nM, about 16 to about 17 nM, about 17 to about 18 nM, about 18 to about 19 nM, or about 19 to about 20 nM, or e.g., greater than about 0.2, about 0.3, about 0.4, about 0.5, about 0.6, about 0.7, about 0.8, about 0.9, about 1, about 1.1, about 1.2, about 1.3, about 1.4. about 1.5, about 2, about 3, about 4, about 5, about 6, about 7, about 8, about 9, about 10, about 11, about 12, about 13, about 14, about 15, about 16, about 17, about 18, or about 20 nM, e.g., as determined by yeast surface display.

In an embodiment, the IL-2 variant binds to CD122/CD132 heterodimer (e.g., human CD122/CD132 heterodimer) with low affinity, e.g., with a dissociation constant (KD) of about 0.2-300 nM, e.g., about 0.2 nM, about 0.5 nM, about 1 nM, about 2 nM, about 5 nM, about 10 nM, about 15 nM, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about 190 nM, about 200 nM, about 210 nM, about 220 nM, about 230 nM, about 240 nM, about 250 nM, about 260 nM, about 270 nM, about 280 nM, about 290 nM, or about 300 nM, or e.g., about 0.5 to about 15 nM, about 1 to about 10 nM, about 2 to about 5 nM, about 0.2 nM to about 0.5 nM, about 0.5 nM to about 1 nM, about 1 to about 2 nM, about 2 nM to about 5 nM, about 5 nM to about 10 nM, about 10 nM to about 15 nM, about 15 nM to about 20 nM, about 20 nM to about 25 nM, about 25 to about 30 nM, about 30 nM to about 40 nM, about 40 nM to about 50 nM, about 50 to about 60 nM, about 60 to about 70 nM, about 70 nM to about 80 nM, about 80 nM to about 90 nM, about 90 nM to about 100 nM, about 100 nM to about 110 nM, about 110 nM to about 120 nM, about 120 nM to about 130 nM, about 130 nM to about 140 nM, about 140 nM to about 150 nM, about 150 nM to about 160 nM, about 160 nM to about 170 nM, about 170 nM to about 180 nM, about 180 nM to about 190 nM, about 190 nM to about 200 nM, about 200 nM to about 210 nM, about 210 nM to about 220 nM, about 220 nM to about 230 nM, about 230 nM to about 240 nM, about 240 nM to about 250 nM, about 250 nM to about 260 nM, about 260 nM to about 270 nM, about 270 nM to about 280 nM, about 280 nM to about 290 nM, or about 290 nM to about 300 nM, or e.g., greater than about 0.2, about 0.5, about 1, about 2, about 5, about 10, about 15, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about 190 nM, about 200 nM, about 210 nM, about 220 nM, about 230 nM, about 240 nM, about 250 nM, about 260 nM, about 270 nM, about 280 nM, about 290 nM, or greater than about 300 nM, e.g., as determined by surface plasmon resonance (e.g. Biacore) and/or biolayer interferometry (e.g. Octet binding).

In an embodiment, the IL-2 variant has altered (e.g., enhanced, increased, and/or selective) binding to Tregs in vitro and/or in vivo, relative to a wild-type IL-2 or a reference IL-2 variant. In an embodiment, the IL-2 variant has enhanced or increased binding to Tregs relative to a wild-type IL-2. In an embodiment, the IL-2 variant has selective binding to Tregs relative to IL-2 (e.g., wild type human IL-2). In an embodiment, the IL-2 variant has enhanced or increased binding to Tregs relative to a reference IL-2 variant. In an embodiment, the IL-2 variant has selective binding to Tregs relative to a reference IL-2 variant. In an embodiment, the binding to Tregs is increased by about 1%, 5%, 10%, 20%, 30%, 40%, 50%, 60%, 70%, 80%, 90%, 95%, or about 100%, or more. In an embodiment, the binding to Tregs is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has altered (e.g., enhanced, increased, and/or selective) activation of the IL-2 signaling pathway in Tregs in vitro and/or in vivo, relative to a wild-type IL-2 or a reference IL-2 variant. In an embodiment, the IL-2 variant has enhanced or increased activation of the IL-2 signaling pathway in Tregs relative to a wild-type IL-2. In an embodiment, the IL-2 variant has selective activation of the IL-2 signaling pathway in Tregs relative to a wild-type IL-2. In an embodiment, the IL-2 variant has enhanced or increased activation of the IL-2 signaling pathway in Tregs relative to a reference IL-2 variant. In an embodiment, the IL-2 variant has selective activation of the IL-2 signaling pathway in Tregs relative to a reference IL-2 variant. In an embodiment, the activation of the IL-2 signaling pathway in Tregs is increased by about 1%, 5%, 10%, 20%, 30%, 40%, 50%, 60%, 70%, 80%, 90%, 95%, or about 100%, or more. In an embodiment, the activation of the IL-2 signaling pathway in Tregs is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant selectively activates IL-2 signaling in T regulatory cells in vitro and/or in vivo, e.g., having an T helper EC50/Treg EC50 ratio greater than about 1, about 2, about 3, about 4, about 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 150, 200, 250, 300, 350, 400, 450, 500, 600, 700, 800, 900, 1000, 1500, 2000, 2500, or about 3000 or more relative to an IL-2 agent comprising a wild-type IL-2 or an IL-2 agent comprising a reference IL-2 variant e.g., as determined flow cytometry.

In an embodiment, the IL-2 variant selectively activates IL-2 signaling in T regulatory cells in vitro and/or in vivo, e.g., having an NK cell EC50/Treg EC50 ratio greater than e.g., about 1, about 2, about 3, about 4, about 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 150, 200, 250, 300, 350, 400, 450, 500, 600, 700, 800, 900, 1000, 1500, 2000, 2500, or about 3000 or more, or e.g., greater than 1 and about 1 to 2, about 2 to 3, about 3 to 4, about 4 to 5, greater than 1 and about 1 to 10, greater than 1 and about 1 to 20, greater than 1 and about 1 to 30, greater than 1 and about 1 to 40, greater than 1 and about 1 to 50, about 2 to 10, about 2 to 20, about 2 to 30, about 2 to 40, 2 to 50, about 5 to 10, about 5 to 20, about 5 to 30, about 5 to 40, about 5 to 50, about 10 to 20, about 10 to 30, about 10 to 40 about 10 to 50, about 20 to 40, about 20 to 50, about 50 to 100, about 100 to 200, about 200 to 500, about 500 to 1000, about 1000 to 2000, or about 1000 to 3000, relative to an IL-2 agent comprising a wild-type IL-2 or an IL-2 agent comprising a reference IL-2 variant e.g., as determined flow cytometry.

In an embodiment, the IL-2 variant has altered (e.g., enhanced, increased, and/or selective) ability to induce or promote Treg expansion, activity, survival, and/or proliferation in vitro and/or in vivo, relative to a wild-type IL-2 or a reference IL-2 variant. In an embodiment, the IL-2 variant has enhanced or increased ability to induce or promote Treg expansion, activity, survival, and/or proliferation relative to a wild-type IL-2. In an embodiment, the IL-2 variant has selective ability to induce or promote Treg expansion, activity, survival, and/or proliferation relative to a wild-type IL-2. In an embodiment, the IL-2 variant has enhanced or increased ability to induce or promote Treg expansion, activity, survival, and/or proliferation relative to a reference IL-2 variant. In an embodiment, the IL-2 variant has selective ability to induce or promote Treg expansion, activity, survival, and/or proliferation relative to a reference IL-2 variant. In an embodiment, the ability to induce or promote Treg expansion, activity, survival, and/or proliferation is increased by about 1%, 5%, 10%, 20%, 30%, 40%, 50%, 60%, 70%, 80%, 90%, 95%, or about 100%, or more. In an embodiment, the ability to induce or promote Treg expansion, activity, survival, and/or proliferation is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 variant has enhanced or increased potency and/or ability to induce or promote T regulatory cell activity, e.g., having an EC50 for Tregs that is lower by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 agent comprising a wild-type IL-2 or an IL-2 agent comprising a reference IL-2 variant e.g., as determined flow cytometry.

In an embodiment, the IL-2 variant has reduced or decreased potency and/or ability to induce or promote T regulatory cell activity, e.g., having an EC50 for Tregs that is higher by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, about 50-fold, about 100-fold, about 200-fold, about 500-fold, about 1000-fold, about 2000-fold, about 5000-fold, about 10,000, about 15,000-fold, or about 20,000-fold or more e.g., relative to an IL-2 agent comprising a wild-type IL-2 or an IL-2 agent comprising a reference IL-2 variant e.g., as determined flow cytometry.

In an embodiment, the T helper cell described herein is a CD45+CD3+CD4+Foxp3− cell, e.g., determined by flow cytometry. In an embodiment, the Treg described herein is CD45+CD3+CD4+Foxp3+ cell, e.g., determined by flow cytometry. In an embodiment, the NK cell described herein is a CD45+CD3− cell that is CD56+ and/or CD16+, e.g., determined by flow cytometry. In an embodiment, the NK cell described herein is a CD45+CD3-CD56+ cell, e.g., determined by flow cytometry.

In an embodiment, the IL-2 variant has one or more of the same, or substantially the same, structural and/or functional properties, as a wild-type IL-2 or a reference IL-2 variant.

In an embodiment, the reference IL-2 variant comprises an amino acid sequence that has about 75%, 80%, 85%, 90%, 91%, 92%, 93%, 94%, 95%, 96%, 97%, 98%, 99%, or more sequence identity to an IL-2 variant described herein. In an embodiment, the reference IL-2 variant comprises the amino acid sequence of SEQ ID NO: 1 (IL-2 C125S). In an embodiment, the IL-2 variant comprises an amino acid sequence that is at least 80%, 85%, 90%, 95%, or 98% identical to the amino acid sequence of SEQ ID NO: 1 and comprises one or more (2, 3, 4, 5, 6, 7, 8, 9, 10, or more) amino acid alterations (e.g., substitutions) described herein.

For purposes of this disclosure, IL-2 variant position numbering begins at the first amino acid following the signal peptide of the exemplary wild type (WT) human IL-2 polypeptide:

MYRMQLLSCIALSLALVTNS/A1/P2/T3/S4/S5/S6/T7/K8/

K9/T10/Q11/L12/Q13/L14/E15/H16/L17/L18/L19/

D20/L21/Q22/M23/I24/L25/N26/G27/I28/N29/N30/

Y31/K32/N33/P34/K35/L36/T37/R38/M39/L40/T41/

F42/K43/F44/Y45/M46/P47/K48/K49/A50/T51/E52/

L53/K54/H55/L56/Q57/C58/L59/E60/E61/E62/L63/

K64/P65/L66/E67/E68/V69/L70/N71/L72/A73/Q74/

S75/K76/N77/F78/H79/L80/R81/P82/R83/D84/L85/

I86/S87/N88/I89/N90/V91/I92/V93/L94/E95/L96/

K97/G98/S99/E100/T101/T102/F103/M104/C105/

E106/Y107/A108/D109/E110/T111/A112/T113/

I114/V115/E116/F117/L118/N119/R120/W121/I122/

T123/F124/C125/Q126/S127/I128/I129/S130/T131/

L132/T133
(SEQ ID NO: 360; Uniprot P60568; signal peptide underlined).

The corresponding amino acid sequence without the signal peptide is shown as SEQ ID NO: 1031.

In an embodiment, the IL-2 agent comprises amino acid alteration(s) (e.g., substitution(s)) at position(s) corresponding to human IL-2 (e.g., comprising the amino acid sequence of SEQ ID NO: 1031).

In an embodiment, the IL-2 variant comprises the amino acid sequence of (SEQ ID NO: 1032)
A1/P2/X3/S4/S5/S6/T7/K8/K9/T10/Q11/L12/Q13/L14/

E15/X16/L17/L18/L19/D20/L21/Q22/M23/I24/L25/

N26/G27/X28/N29/N30/Y31/K32/N33/P34/X35/L36/

T37/X38/M39/L40/T41/X42/K43/F44/Y45/M46/P47/

K48/K49/A50/T51/E52/L53/K54/H55/L56/Q57/C58/

L59/E60/E61/E62/L63/K64/P65/L66/E67/X68/X69/

L70/N71/L72/A73/X74/S75/K76/N77/F78/H79/L80/

R81/P82/R83/X84/L85/I86/X87/X88/I89/N90/V91/

X92/V93/L94/E95/L96/K97/G98/S99/E100/T101/

T102/F103/M104/C105/E106/Y107/A108/D109/E110/

T111/A112/T113/T114/V115/E116/F117/L118/N119/

R120/W121/I122/T123/F124/X125/X126/S127/I128/

I129/S130/T131/L132/T133, wherein: X3 is T or A; X16 is H, L or N; X28 is I, T or F; X35 is K or E; X38 is R, E, N or Q; X42 is F, A, K or Q; X68 is E, Q or N; X69 is V or A; X74 is Q or P; X84 is D or V; X87 is S or R; X88 is N, D, L or S; X92 is I or S; X125 is C or S; and X126 is Q, K, R or T, provided that the IL-2 variant does not comprise the amino acid sequence of SEQ ID NO: 1 or 1031. In an embodiment, the IL-2 variant comprises, or consists of, an IL-2 variant amino acid sequence described herein.

In an embodiment, the IL-2 variant comprises an amino acid alteration (e.g., substitution) at one or more (e.g., 2, 3, 4, 5, 6, 7, 8, 9, 10, 11, 12, 13, 14, or all) of positions, as described herein. In an embodiment, the IL-2 variant comprises an amino acid alteration (e.g., substitution) at one or more (e.g., 2, 3, 4, 5, 6, 7, 8, 9, 10, 11, 12, 13, 14, or all) of positions chosen from T3, H16, I28, K35, R38, F42, E68, V69, Q74, D84, S87, N88, I92, C125, or Q126.

In an embodiment, the IL-2 variant comprises an amino acid alteration (e.g., substitution) at position T3. In an embodiment, the IL-2 variant comprises an amino acid alteration (e.g., substitution) at position H16. In an embodiment, the IL-2 variant comprises an amino acid alteration (e.g., substitution) at position I28. In an embodiment, the IL-2 variant comprises an amino acid alteration (e.g., substitution) at position K35. In an embodiment, the IL-2 variant comprises an amino acid alteration (e.g., substitution) at position R38. In an embodiment, the IL-2 variant comprises an amino acid alteration (e.g., substitution) at position F42. In an embodiment, the IL-2 variant comprises an amino acid alteration (e.g., substitution) at position E68. In an embodiment, the IL-2 variant comprises an amino acid alteration (e.g., substitution) at position V69. In an embodiment, the IL-2 variant comprises an amino acid alteration (e.g., substitution) at position Q74. In an embodiment, the IL-2 variant comprises an amino acid alteration (e.g., substitution) at position D84. In an embodiment, the IL-2 variant comprises an amino acid alteration (e.g., substitution) at position S87. In an embodiment, the IL-2 variant comprises an amino acid alteration (e.g., substitution) at position N88. In an embodiment, the IL-2 variant comprises an amino acid alteration (e.g., substitution) at position I92. In an embodiment, the IL-2 variant comprises an amino acid alteration (e.g., substitution) at position C125. In an embodiment, the IL-2 variant comprises an amino acid alteration (e.g., substitution) at position Q126.

In an embodiment, the IL-2 variant comprises an amino acid alteration (e.g., substitution) at position V69, Q74, or a combination thereof. In an embodiment, the IL-2 variant comprises an amino acid alteration (e.g., substitution) at positions V69 and Q74. In an embodiment, the IL-2 variant comprises the amino acid substitution V69A. In an embodiment, the IL-2 variant comprises the amino acid substitution Q74P.

In an embodiment, the IL-2 variant comprises an amino acid alteration (e.g., substitution) at position H16, I92, D84, or a combination thereof. In an embodiment, the IL-2 variant comprises an amino acid alteration (e.g., substitution) at position H16, optionally wherein the amino acid substitution is H16N, H16L, or H16D. In an embodiment, the IL-2 variant comprises the amino acid substitution H16N. In an embodiment, the IL-2 variant comprises the amino acid substitution H16L. In an embodiment, the IL-2 variant comprises the amino acid substitution H16D.

In an embodiment, the IL-2 variant comprises an amino acid alteration (e.g., substitution) at position at I92, optionally wherein the amino acid substitution is I92S. In an embodiment, the IL-2 variant comprises the amino acid substitution I92S.

In an embodiment, the IL-2 variant comprises an amino acid alteration (e.g., substitution) at position D84, optionally wherein the amino acid substitution is D84V. In an embodiment, the IL-2 variant comprises the amino acid substitution is D84V.

In an embodiment, the IL-2 variant comprises an amino acid alteration (e.g., substitution) at position K35, R38, F42, E68, or a combination thereof. In an embodiment, the IL-2 variant comprises an amino acid alteration (e.g., substitution) at position K35, optionally wherein the amino acid substitution is K35E. In an embodiment, IL-2 variant comprises the amino acid substitution K35E.

In an embodiment, the IL-2 variant comprises an amino acid alteration (e.g., substitution) at position R38, optionally wherein the amino acid substitution is R38E, R38N or R38Q. In an embodiment, the IL-2 variant comprises the amino acid substitution R38N. In an embodiment, the IL-2 variant comprises the amino acid substitution R38Q.

In an embodiment, the IL-2 variant comprises an amino acid alteration (e.g., substitution) at position F42, optionally wherein the amino acid substitution is F42K or F42Q. In an embodiment, the IL-2 variant comprises the amino acid substitution F42K. In an embodiment, the IL-2 variant comprises the amino acid substitution F42Q.

In an embodiment, the IL-2 variant comprises an amino acid alteration (e.g., substitution): (i) at (a) positions V69 and Q74, (b) position K35, or (c) positions V69, Q74, and K35; and (ii) at one, two, or all of positions H16, I92, or D84. In an embodiment, the IL-2 variant further comprises an amino acid alteration (e.g., substitution) at one, two, or all of positions R38, F42, or E68.

In an embodiment, the IL-2 variant comprises an amino acid alteration (e.g., substitution): (i) at (a) positions V69 and Q74, (b) position K35, or (c) positions V69, Q74, and K35; and (ii) at (a) one, two, or all of positions H16, I92, or D84; or (b) one, two, or all of positions R38, F42, or E68.

In an embodiment, the IL-2 variant comprises an amino acid alteration (e.g., substitution): (i) at (a) positions V69 and Q74, (b) position K35, or (c) positions V69, Q74, and K35; and (ii) at (a) one, two, or all of positions H16, I92, or D84; and (b) one, two, or all of positions R38, F42, or E68.

In an embodiment, the IL-2 variant comprises an amino acid alteration (e.g., substitution) at position V69, Q74, and H16, optionally wherein the amino acid substitution is V69A, Q74P, and H16N or H16L, respectively. In an embodiment, the IL-2 variant comprises the amino acid substitutions V69A, Q74P, and H16N or H16L. In an embodiment, the IL-2 variant comprises the amino acid substitutions V69A, Q74P, and H16N. In an embodiment, the IL-2 variant comprises the amino acid substitutions V69A, Q74P, and H16L.

In an embodiment, the IL-2 variant comprises an amino acid alteration (e.g., substitution) at position V69, Q74, and I92, optionally wherein the amino acid substitution is V69A, Q74P, and I92S, respectively. In an embodiment, the IL-2 variant comprises the amino acid substitutions V69A, Q74P, and I92S.

In an embodiment, the IL-2 variant comprises an amino acid alteration (e.g., substitution) at position V69, Q74, and D84, optionally wherein the amino acid substitution is V69A, Q74P, and D84V, respectively. In an embodiment, the IL-2 variant comprises the amino acid substitutions V69A, Q74P, and D84V.

In an embodiment, the IL-2 variant comprises an amino acid alteration (e.g., substitution) at position V69, Q74, and R38, optionally wherein the amino acid substitution is V69A, Q74P, and R38Q, respectively. In an embodiment, the IL-2 variant comprises the amino acid substitutions V69A, Q74P, and R38Q.

In an embodiment, the IL-2 variant comprises an amino acid alteration (e.g., substitution) at position V69, Q74, and F42, optionally wherein the amino acid substitution is V69A, Q74P, and F42Q, respectively. In an embodiment, the IL-2 variant comprises the amino acid substitutions V69A, Q74P, and F42Q.

In an embodiment, the IL-2 variant comprises an amino acid alteration (e.g., substitution) at position V69, Q74, and R38, optionally wherein the amino acid substitution is V69A, Q74P, and R38N, respectively. In an embodiment, the IL-2 variant comprises the amino acid substitutions V69A, Q74P, and R38N.

In an embodiment, the IL-2 variant comprises an amino acid alteration (e.g., substitution) at position V69, Q74, and R38, optionally wherein the amino acid substitution is V69A, Q74P, and R38E, respectively. In an embodiment, the IL-2 variant comprises the amino acid substitution V69A, Q74P, and R38E.

In an embodiment, the IL-2 variant comprises an amino acid alteration (e.g., substitution) at position V69, Q74, K35, and H16, optionally wherein the amino acid substitution is V69A, Q74P, K35E, and H16N, respectively. In an embodiment, the IL-2 variant comprises the amino acid substitutions V69A, Q74P, K35E, and H16N.

In an embodiment, the IL-2 variant comprises an amino acid alteration (e.g., substitution) at position V69, Q74, K35, H16, and R38, optionally wherein the amino acid substitution is V69A, Q74P, K35E, H16N, and R38N, respectively. In an embodiment, the IL-2 variant comprises the amino acid substitutions V69A, Q74P, K35E, H16N, and R38N.

In an embodiment, the IL-2 variant comprises an amino acid alteration (e.g., substitution) at position V69, Q74, H16, and R38, optionally wherein the amino acid substitution is V69A, Q74P, H16N, and R38N or R38Q, respectively. In an embodiment, the IL-2 variant comprises the amino acid substitutions V69A, Q74P, H16N, and R38N or R38Q. In an embodiment, the IL-2 variant comprises the amino acid substitutions V69A, Q74P, H16N, and R38N. In an embodiment, the IL-2 variant comprises the amino acid substitutions V69A, Q74P, H16N, and R38Q.

In an embodiment, the IL-2 variant comprises an amino acid alteration (e.g., substitution) at position I28, E68, S87, N88, Q126, or a combination thereof.

In an embodiment, the IL-2 variant comprises an amino acid alteration (e.g., substitution) at position I28, optionally wherein the amino acid substitution is I28T or I28F. In an embodiment, the IL-2 variant comprises the amino acid substitution I28T. In an embodiment, the IL-2 variant comprises the amino acid substitution I28F.

In an embodiment, the IL-2 variant comprises an amino acid alteration (e.g., substitution) at position E68, optionally wherein the amino acid substitution is E68Q or E68N. In an embodiment, the IL-2 variant comprises the amino acid substitution E68Q. In an embodiment, the IL-2 variant comprises the amino acid substitution E68N.

In an embodiment, the IL-2 variant comprises an amino acid alteration (e.g., substitution) at position S87, optionally wherein the amino acid substitution is S87R. In an embodiment, the IL-2 variant comprises the amino acid substitution S87R.

In an embodiment, the IL-2 variant comprises an amino acid alteration (e.g., substitution) at position N88, optionally wherein the amino acid substitution is N88S, N88L, or N88D. In an embodiment, the IL-2 variant comprises the amino acid substitution N88S, N88L, or N88D. In an embodiment, the IL-2 variant comprises the amino acid substitution N88S. In an embodiment, the IL-2 variant comprises the amino acid substitution N88L. In an embodiment, the IL-2 variant comprises the amino acid substitution N88D.

In an embodiment, the IL-2 variant comprises an amino acid alteration (e.g., substitution) at position Q126, optionally wherein the amino acid substitution is Q126T, Q126K, or Q126R. In an embodiment, the IL-2 variant comprises the amino acid substitution Q126T, Q126K, or Q126R. In an embodiment, the IL-2 variant comprises the amino acid substitution Q126T, Q126K, or Q126R. In an embodiment, the IL-2 variant comprises the amino acid substitution Q126T. In an embodiment, the IL-2 variant comprises the amino acid substitution Q126K. In an embodiment, the IL-2 variant comprises the amino acid substitution Q126R.

In an embodiment, the IL-2 variant comprises an amino acid alteration (e.g., substitution) at position C125, optionally wherein the amino acid substitution is C125S. In an embodiment, the IL-2 variant comprises the amino acid substitution C125S.

In an embodiment, the IL-2 variant comprises an amino acid alteration (e.g., substitution) at position T3, optionally wherein the amino acid substitution is T3A. In an embodiment, the IL-2 variant comprises the amino acid substitution T3A.

In an embodiment, the IL-2 variant comprises an amino acid alteration (e.g., substitution) at position V69, Q74, and C125, optionally wherein the amino acid substitution is V69A, Q74P, and C125S, respectively. In an embodiment, the IL-2 variant comprises the amino acid substitutions V69A, Q74P, and C125S.

In an embodiment, the IL-2 variant comprises an amino acid alteration (e.g., substitution) at position T3, H16, I92, or a combination thereof, optionally wherein the amino acid substitution is T3A, H16N, and I92S, respectively.

In an embodiment, the IL-2 variant comprises an amino acid alteration (e.g., substitution) at position H16, V69, Q74, and C125, optionally wherein the amino acid substitution is H16N, V69A, Q74P, and C125S, respectively. In an embodiment, the IL-2 variant comprises the amino acid substitutions H16N, V69A, Q74P, and C125S.

In an embodiment, the IL-2 variant comprises an amino acid alteration (e.g., substitution) at position H16, V69, Q74, and C125, optionally wherein the amino acid substitution is H16L, V69A, Q74P, and C125S, respectively. In an embodiment, the IL-2 variant comprises the amino acid substitutions H16L, V69A, Q74P, and C125S.

In an embodiment, the IL-2 variant comprises an amino acid alteration (e.g., substitution) at position H16, V69, Q74, I92, and C125, optionally wherein the amino acid substitution is H16L, V69A, Q74P, I92S, and C125S, respectively. In an embodiment, the IL-2 variant comprises the amino acid substitutions H16L, V69A, Q74P, I92S, and C125S.

In an embodiment, the IL-2 variant comprises an amino acid alteration (e.g., substitution) at position T3, V69, Q74, and C125, optionally wherein the amino acid substitution is T3A, V69A, Q74P, and C125S, respectively. In an embodiment, the IL-2 variant comprises the amino acid substitutions T3A, V69A, Q74P, and C125S.

In an embodiment, the IL-2 variant comprises an amino acid alteration (e.g., substitution) at position T3, H16, V69, Q74, and C125, optionally wherein the amino acid substitution is T3A, H16N or H16L, V69A, Q74P, and C125S, respectively. In an embodiment, the IL-2 variant comprises the amino acid substitutions T3A, H16N, V69A, Q74P, and C125S. In an embodiment, the IL-2 variant comprises the amino acid substitutions T3A, H16L, V69A, Q74P, and C125S.

In an embodiment, the IL-2 variant comprises an amino acid alteration (e.g., substitution) at position T3, V69, Q74, I92, and C125, optionally wherein the amino acid substitution is T3A, V69A, Q74P, I92S, and C125S, respectively. In an embodiment, the IL-2 variant comprises the amino acid substitutions T3A, V69A, Q74P, I92S, and C125S.

In an embodiment, the IL-2 variant comprises an amino acid alteration (e.g., substitution) at position H16, K35, V69 and Q74, optionally wherein the amino acid substitution is H16L, K35E, V69A, and Q74P, respectively. In an embodiment, the IL-2 variant comprises the amino acid substitutions H16L, K35E, V69A, and Q74P.

In an embodiment, the IL-2 variant comprises an amino acid alteration (e.g., substitution) at position H16, R38, V69A, and Q74P, optionally wherein the amino acid substitution is H16L, R38Q, V69A, and Q74P, respectively. In an embodiment, the IL-2 variant comprises the amino acid substitutions H16L, R38Q, V69A, and Q74P.

In an embodiment, the IL-2 variant comprises amino acid substitutions H16L, V69A, Q74P, and C125S. In an embodiment, the IL-2 variant comprises amino acid substitutions H16N, V69A, Q74P, and C125S.

There are various technical effects associated with the presence of the particular sets of mutations described herein, for example, a set of mutations comprising an amino acid substitution at position H16, in combination with amino acid substitutions at positions V69, Q74, and C125 (e.g., H16L, V69A, Q74P, and C125S). Without wishing to be bound by theory, it is believed that in an embodiment, an IL-2 variant comprising the aforesaid mutations also has reduced binding affinity for CD122 and/or CD132, which increases the potency and selectivity of the IL-2 variant for regulatory T cells (Treg) compared to other T cell types. Without wishing to be bound by theory, it is also believed that in an embodiment, an IL-2 variant comprising the aforesaid mutations is significantly stable, e.g., due to the presence of stabilizing V69A and Q74P mutations. For example, it was unexpected discovered that the V69A and Q74P substitutions do not substantially increase the binding affinity of the IL-2 variant for CD25, but rather stabilize the IL-2 variant in an active conformation sufficient for binding to CD25. Therefore, an IL-2 variant comprising these mutations selectively activates regulatory T cells (Treg) and is significantly stable. Without wishing to be bound by theory, it is further believed that in an embodiment, an IL-2 variant comprising the aforesaid mutations has reduced or decreased binding capacity and/or binding affinity for CD25, which improves the lifetime of the IL-2 variant. Without wishing to be bound by theory, it is also believed that in an embodiment, an IL-2 variant comprising these mutations does not substantially promote expansion, activation, survival, and/or proliferation of T effector cells and/or natural killer (NK) cells in vitro and/or in vivo. Without wishing to be bound by theory, it is further believed that in an embodiment, an IL-2 variant comprising the aforesaid mutations has reduced incorrect disulfide pairing and improved stability, e.g., due to the presence of the C125S mutation. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 variant comprising these mutations particularly suitable for treating disorders and conditions arising from abnormal immune responses, such as autoimmune diseases.

Thus, in an embodiment, an IL-2 variant (e.g., IL-2 variant or IL-2 fusion protein) comprising an amino acid substitution at position H16 in combination with amino acid substitutions at positions V69, Q74, and C125 (e.g., H16L, V69A, Q74P, and C125S), has inter alia one or more (e.g., 2, 3, 4, 5, 6, 7, or all) of the following properties relative to a wild-type IL-2 or a reference IL-2 variant that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 variant for the heterodimeric IL-2 receptor composed of human CD122 and human CD132 (i.e. human CD122/CD132 heterodimer) in vitro and/or in vivo; (v) reduced or decreased binding capacity and/or binding affinity for human CD25 in vitro and/or in vivo; (vi) selective binding to regulatory T cells (e.g. Foxp3+ T cells); (vii) selective activation of the IL-2 signaling pathway in T regulatory cells (Tregs) in vitro or in vivo; or (viii) enhanced or increased ability to induce or promote Treg expansion, activity, survival and/or proliferation.

In an embodiment, the IL-2 variant comprises, or consists of, an amino acid sequence chosen from: SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 variant comprises, or consists of, the amino acid sequence of SEQ ID NO: 4, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 variant comprises, or consists of, the amino acid sequence of SEQ ID NO: 5, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 variant comprises, or consists of, the amino acid sequence of SEQ ID NO: 11, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 variant comprises, or consists of, the amino acid sequence of SEQ ID NO: 1000, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 variant comprises, or consists of, the amino acid sequence of SEQ ID NO: 1001, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 variant comprises, or consists of, the amino acid sequence of SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 variant comprises, or consists of, the amino acid sequence of any of SEQ ID NOs: 4, 5, 11, 1000, 1001, or 1002, or a functional fragment thereof. In an embodiment, the IL-2 variant comprises, or consists of, the amino acid sequence of SEQ ID NO: 4 or 5, or a functional fragment thereof. In an embodiment, the IL-2 variant comprises, or consists of, the amino acid sequence of SEQ ID NO: 4, or a functional fragment thereof. In an embodiment, the IL-2 variant comprises, or consists of, the amino acid sequence of SEQ ID NO: 5, or a functional fragment thereof. In an embodiment, the IL-2 variant comprises, or consists of, the amino acid sequence of SEQ ID NO: 11, or a functional fragment thereof. In an embodiment, the IL-2 variant comprises, or consists of, the amino acid sequence of SEQ ID NO: 1000, or a functional fragment thereof. In an embodiment, the IL-2 variant comprises, or consists of, the amino acid sequence of SEQ ID NO: 1001, or a functional fragment thereof. In an embodiment, the IL-2 variant comprises, or consists of, the amino acid sequence of SEQ ID NO: 1002, or a functional fragment thereof.

Without wishing to be bound by theory, it is believed that in an embodiment, an IL-2 variant comprising, or consisting of, the amino acid sequence of SEQ ID NO: 5, or a functional fragment thereof, can have at least one or more of the following advantageous properties: (i) has reduced binding affinity for CD122 and/or CD132, which increases the potency and selectivity of the IL-2 agent for regulatory T cells (Treg) compared to other T cell types; (ii) is significantly stable, e.g., due to the presence of stabilizing V69A and Q74P mutations; (iii) has reduced or decreased binding capacity and/or binding affinity for CD25, which improves the lifetime of the IL-2 agent; (iv) does not substantially promote expansion, activation, survival, and/or proliferation of T effector cells and/or natural killer (NK) cells in vitro and/or in vivo; and/or (v) has reduced incorrect disulfide pairing and improved stability, e.g., due to the presence of the C125S mutation. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 variant comprising, or consisting of, the amino acid sequence of SEQ ID NO: 5 particularly suitable for treating disorders and conditions arising from abnormal immune responses, such as autoimmune diseases.

Thus, in an embodiment, an IL-2 variant comprising, or consisting of, the amino acid sequence SEQ ID NO: 5, or a functional fragment thereof, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto, has inter alia one or more (e.g., 2, 3, 4, 5, 6, 7, or all) of the following properties relative to a wild-type IL-2 or a reference IL-2 variant that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 variant for the heterodimeric IL-2 receptor composed of human CD122 and human CD132 (i.e. human CD122/CD132 heterodimer) in vitro and/or in vivo; (v) reduced or decreased or substantially unchanged binding capacity and/or binding affinity for human CD25 in vitro and/or in vivo; (vi) selective binding to regulatory T cells (e.g. Foxp3+ T cells); (vii) selective activation of the IL-2 signaling pathway in T regulatory cells (Tregs) in vitro or in vivo; or (viii) enhanced or increased ability to induce or promote Treg expansion, activity, survival and/or proliferation.

As described further herein, the disclosure provides IL-2 fusion proteins, IL-2 complexes, and IL-2 conjugates comprising an IL-2 variant described herein. In an embodiment, one or more different and/or improved properties ascribed to an IL-2 variant described herein is maintained, transferred, or imparted to the IL-2 fusion protein, IL-2 complex, or IL-2. For the purposes of the present disclosure, the terms "IL-2 variant" and "IL-2 mutein" may be used interchangeably herein.

In an embodiment, the IL-2 variant comprises a polypeptide (sometime referred to herein as "IL-2 variant polypeptide"). This disclosure provides an isolated nucleic acid molecule encoding an IL-2 variant described herein, and vectors and host cells thereof. The nucleic acid molecule includes, but is not limited to, RNA, genomic DNA and cDNA.

IL-2 Fusion Proteins

In an embodiment, the IL-2 agent comprises an IL-2 fusion protein, e.g., an IL-2 fusion protein described herein.

In an embodiment, the IL-2 fusion protein comprises an IL-2 variant, e.g., an IL-2 variant described herein. In an embodiment, the IL-2 fusion protein comprises one or more amino acid alterations (e.g., substitutions) described in Table 9. In an embodiment, the IL-2 fusion protein comprises an amino acid sequence described in Table 9, or a functional fragment thereof. In an embodiment, the IL-2 variant is encoded by a nucleic acid comprising a nucleotide sequence described herein, e.g., in Table 10.

Without wishing to be bound by theory, it is believed that in an embodiment, the IL-2 fusion proteins described herein, which have reduced human CD25 and/or reduced human CD122/CD132 binding affinity relative to a IL-2 fusion protein comprising a wild-type human IL-2 or a reference IL-2 fusion protein, can have improved potency and/or selectivity for binding to and activating regulatory T cells (Tregs) than IL-2 fusion proteins comprising a wild-type human IL-2 or other IL-2 fusion protein.

In an embodiment, the IL-2 fusion protein has one or more (e.g., 2, 3, 4, 5, 6, 7, 8, 9, 10, 11, 12, or more) properties described herein, e.g., different and/or improved properties, relative to an IL-2 fusion protein comprising a wild-type IL-2 or a reference IL-2 fusion protein. In an embodiment, the IL-2 fusion protein comprises one or more (e.g., 2, 3, 4, 5, 6, 7, 8, 9, 10, or more) amino acid alterations (e.g., substitutions) that provide different and/or improved properties, relative to an IL-2 fusion protein comprising a wild-type IL-2 or a reference IL-2 fusion protein. In an embodiment, the IL-2 fusion protein has one or more (e.g., 2, 3, 4, 5, 6, 7, 8, 9, 10, 11, 12, or all) of the following different and/or improved properties (e.g., as determined by an assay described herein), relative to an IL-2 fusion protein comprising a wild-type IL-2 or a reference IL-2 fusion protein:

i) altered (e.g., enhanced or increased) expression in vitro and/or in vivo;
ii) altered (e.g., reduced or decreased) aggregation in vitro and/or in vivo;
iii) altered (e.g., enhanced or increased) stability in vitro and/or in vivo;
iv) altered (e.g., enhanced or increased) half-life in vitro and/or in vivo;
v) altered (e.g., reduced or decreased) turnover and/or clearance in vivo;
vi) altered (e.g., reduced or decreased) susceptibility to proteolysis in vitro and/or in vivo;
vii) altered (e.g., enhanced or increased) resistance to proteolysis in vitro and/or in vivo;
viii) altered (e.g., reduced or decreased) binding capacity and/or binding affinity for human CD25 in vitro and/or in vivo;
ix) altered (e.g., reduced or decreased) binding capacity and/or binding affinity for human CD132 in vitro and/or in vivo;
x) altered (e.g., reduced or decreased) binding capacity and/or binding affinity for the dimeric IL-2 receptor comprising human CD122 and human CD132 in vitro and/or in vivo;
xi) altered (e.g., enhanced, increased, reduced, decreased, and/or selective) binding to Tregs in vitro and/or in vivo;
xii) altered (e.g., enhanced, increased, reduced, decreased, and/or selective) activation of the IL-2 signaling pathway in Tregs in vitro and/or in vivo; or
xiii) altered (e.g., enhanced, increased, reduced, decreased, and/or selective) ability to induce or promote Treg expansion, activity, survival, and/or proliferation in vitro and/or in vivo.

In an embodiment, the IL-2 fusion protein has altered (e.g., enhanced or increased) expression in vitro and/or in vivo, relative to an IL-2 fusion protein comprising a wild-type IL-2 or a reference IL-2 fusion protein. In an embodiment, the IL-2 fusion protein has enhanced or increased expression (e.g., in a bacterial or mammalian cell) relative to an IL-2 fusion protein comprising a wild-type IL-2. In an embodiment, the IL-2 fusion protein has enhanced or increased expression (e.g., in bacterial or mammalian cell) relative to a reference IL-2 fusion protein. In an embodiment, the expression of the IL-2 fusion protein is increased by about 1%, 5%, 10%, 20%, 30%, 40%, 50%, 60%, 70%, 80%, 90%, 95%, or about 100%, or more. In an embodiment, the expression of the IL-2 fusion protein is increased by about 0.5-fold, 1-fold, 2-fold, 3-fold, 4-fold, 5-fold, 6-fold, 7-fold, 8-fold, 9-fold, or about 10-fold, or more. In an embodiment, the IL-2 fusion protein expresses at a higher or increased level in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more e.g., relative to an IL-2 fusion protein comprising a wild-type IL-2 or a reference IL-2 fusion protein e.g., as determined by an assay of protein concentration. In an embodiment, the IL-2 fusion protein expresses at a higher or increased level, e.g., increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein e.g., as determined by an assay of protein concentration.

In an embodiment, the IL-2 fusion protein has altered (e.g., reduced or decreased) aggregation in vitro and/or in vivo, relative to an IL-2 fusion protein comprising a wild-type IL-2 or a reference IL-2 fusion protein. In an embodiment, the IL-2 fusion protein has reduced or decreased aggregation relative to a wild type IL-2. In an embodiment, the IL-2 fusion protein has reduced or decreased aggregation relative to a reference IL-2 fusion protein. In an embodiment, the aggregation of the IL-2 fusion protein is decreased by about 1%, 5%, 10%, 20%, 30%, 40%, 50%, 60%, 70%, 80%, 90%, 95%, or about 100%, or more. In an embodiment, the aggregation of the IL-2 fusion protein is decreased by about 0.5-fold, 1-fold, 2-fold, 3-fold, 4-fold, 5-fold, 6-fold, 7-fold, 8-fold, 9-fold, or about 10-fold, or more. In an embodiment, the IL-2 fusion protein aggregates at lower or decreased level in vitro and/or in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more e.g., relative to an IL-2 fusion protein comprising a wild-type IL-2 or a reference IL-2 fusion protein e.g., as determined by melting temperature analysis (e.g., using fluorimetry), dynamic light scattering, and/or size-exclusion chromatography. In an embodiment, the IL-2 fusion protein aggregates at lower or decreased level, e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein e.g., as determined by melting temperature analysis (e.g., using fluorimetry), dynamic light scattering, and/or size-exclusion chromatography.

In an embodiment, the IL-2 fusion protein has altered (e.g., enhanced or increased) stability in vitro and/or in vivo, relative to an IL-2 fusion protein comprising a wild-type IL-2 or a reference IL-2 fusion protein. In an embodiment, the IL-2 fusion protein has enhanced or increased stability relative to an IL-2 fusion protein comprising a wild-type IL-2. In an embodiment, the IL-2 fusion protein has enhanced or increased stability relative to a reference IL-2 fusion protein. In an embodiment, the stability of the IL-2 fusion protein is increased by about 1%, 5%, 10%, 20%, 30%, 40%, 50%, 60%, 70%, 80%, 90%, 95%, or about 100%, or more. In an embodiment, the stability of the IL-2 fusion protein is increased by about 0.5-fold, 1-fold, 2-fold, 3-fold, 4-fold, 5-fold, 6-fold, 7-fold, 8-fold, 9-fold, or about 10-fold, or more. In an embodiment, the IL-2 fusion protein has enhanced or increased stability in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., increased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein, e.g., as determined by yeast surface display, circular dichroism or related spectroscopic techniques, and/or melting temperature analysis (e.g., using fluorimetry).

In an embodiment, the IL-2 fusion protein has altered (e.g., enhanced or increased) half-life in vitro and/or in vivo, relative to an IL-2 fusion protein comprising a wild-type IL-2 or a reference IL-2 fusion protein. In an embodiment, the IL-2 fusion protein has enhanced or increased half-life relative to an IL-2 fusion protein comprising a wild-type IL-2. In an embodiment, the IL-2 fusion protein has enhanced or increased half-life relative to a reference IL-2 fusion protein. In an embodiment, the half-life of the IL-2 fusion protein is increased by about 1%, 5%, 10%, 20%, 30%, 40%, 50%, 60%, 70%, 80%, 90%, 95%, or about 100%, or more. In an embodiment, the half-life of the IL-2 fusion protein is increased by about 0.5-fold, 1-fold, 2-fold, 3-fold, 4-fold, 5-fold, 6-fold, 7-fold, 8-fold, 9-fold, or about 10-fold, or more. In an embodiment, the IL-2 fusion protein has enhanced or increased half-life in vitro and/or in vivo, e.g., increased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., greater than about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein, e.g., as determined by ELISA, flow cytometry, and/or mass spectrometry.

In an embodiment, the IL-2 fusion protein has altered (e.g., reduced or decreased) turnover in vitro and/or in vivo, relative to an IL-2 fusion protein comprising a wild-type IL-2 or a reference IL-2 fusion protein. In an embodiment, the IL-2 fusion protein has reduced or decreased turnover relative to an IL-2 fusion protein comprising a wild-type IL-2. In an embodiment, the IL-2 fusion protein has reduced or decreased turnover relative to a reference IL-2 fusion protein. In an embodiment, the turnover of the IL-2 fusion protein is decreased by about 1%, 5%, 10%, 20%, 30%, 40%, 50%, 60%, 70%, 80%, 90%, 95%, or about 100%, or more. In an embodiment, the turnover of the IL-2 fusion protein is decreased by about 0.5-fold, 1-fold, 2-fold, 3-fold, 4-fold, 5-fold, 6-fold, 7-fold, 8-fold, 9-fold, about 10-fold, or more. In an embodiment, the IL-2 fusion protein has a lower, reduced or decreased rate or level of turnover and/or clearance in vivo, e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein, e.g., as determined by ELISA, flow cytometry, and/or mass spectrometry.

In an embodiment, the IL-2 fusion protein provided by the disclosure comprise the property of having altered (e.g., reduced or decreased) susceptibility to proteolysis in vitro and/or in vivo, relative to an IL-2 fusion protein comprising a wild-type IL-2 or a reference IL-2 fusion protein. In an embodiment, the IL-2 fusion protein has reduced or decreased susceptibility to proteolysis relative to IL-2 (e.g., wild type human IL-2). In an embodiment, the IL-2 fusion protein has reduced or decreased susceptibility to proteolysis relative to a reference IL-2 fusion protein. In an embodiment, the susceptibility to proteolysis of the IL-2 fusion protein is decreased by about 1%, 5%, 10%, 20%, 30%, 40%, 50%, 60%, 70%, 80%, 90%, 95%, or about 100%, or more. In an embodiment, the susceptibility to proteolysis of the IL-2 fusion protein is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has altered (e.g., enhanced or increased) resistance to proteolysis in vitro and/or in vivo, relative to an IL-2 fusion protein comprising a wild-type IL-2 or a reference IL-2 fusion protein. In an embodiment, the IL-2 fusion protein has enhanced or increased resistance to proteolysis relative to an IL-2 fusion protein comprising a wild-type IL-2. In an embodiment, the IL-2 fusion protein has enhanced or increased resistance to proteolysis relative to a reference IL-2 fusion protein. In an embodiment, the resistance to proteolysis of the IL-2 fusion protein is increased by about 1%, 5%, 10%, 20%, 30%, 40%, 50%, 60%, 70%, 80%, 90%, 95%, or about 100%, or more. In an embodiment, the resistance to proteolysis of the IL-2 fusion protein is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has altered (e.g., reduced or decreased) binding capacity and/or binding affinity for human CD25 in vitro and/or in vivo, relative to an IL-2 fusion protein comprising a wild-type IL-2 or a reference IL-2 fusion protein. In an embodiment, the IL-2 fusion protein has reduced or decreased binding capacity and/or binding affinity for human CD25 relative to a wild-type human IL-2). In an embodiment, the IL-2 fusion protein has reduced or decreased binding capacity and/or binding affinity for human CD25 relative to a reference IL-2 fusion protein. In an embodiment, the binding capacity and/or binding affinity of the IL-2 fusion protein for human CD25 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 fusion protein for human CD25 is decreased by about 0.5-fold, 1-fold, 2-fold, 3-fold, 4-fold, 5-fold, 6-fold, 7-fold, 8-fold, 9-fold, or about 10-fold, or more. In an embodiment, the IL-2 fusion protein has reduced or decreased binding affinity for CD25 (e.g., human CD25), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein e.g., as determined by yeast surface display, surface plasmon resonance (e.g. Biacore) and/or bio-layer interferometry (e.g. Octet binding).

In an embodiment, the IL-2 fusion protein binds to CD25 (e.g., human CD25) with low affinity, e.g., with a dissociation constant ($K_D$) of about 5-500 pM, e.g., about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, or e.g., about 10 to about 400 pM, about 20 to about 300 pM, about 50 to about 200 pM, about 100 to about 150 pM, about 5 to about 10 pM, about 10 to about 20 pM, about 20 to about 30 pM, or about 30 to about 40 pM, e.g., about 40 to about 50 pM, about 50 to about 60 pM, about 60 to about 70 pM, about 70 to about 80 pM, about 80 to about 90 pM, about 90 to about 100 pM, about 100 to about 110 pM, about 110 to about 120 pM, about 120 to about 130 pM, about 130 to about 140 pM about 140 to about 150 pM, about 150 to about 200 pM, about 200 to about 250 pM, about 250 to about 300 pM, about 300 to about 350 pM, about 350 to about 400 pM, about 400 to about 500 pM, or e.g., greater than about 5, about 10, about 15, about 20, about 25, about 30, about 35, about 40, about 45, about 50, about 55, about 60, about 65, about 70, about 75, about 80, about 85, about 90, about 95, about 100, about 105, about 110, about 115, about 120, about 125, about 130, about 135, about 140, about 145, about 150, about 200, about 250, about 300, about 350, about 400, about 450, or about 500 pM, e.g. as determined by yeast surface display, surface plasmon resonance (e.g. Biacore) and/or biolayer interferometry (e.g. Octet binding).

In an embodiment, the IL-2 fusion protein binds to CD25 (e.g., human CD25) with low affinity, e.g., with a dissociation constant ($K_D$) of about 0.1-10 nM, e.g., about 0.1, about 0.2, about 0.3, about 0.4, about 0.5, about 0.6, about 0.7, about 0.8, about 0.9, about 1, about 1.5, about 2, about 2.5, about 3, about 3.5, about 4, about 4.5, about 5, about 6, about 7, about 8, about 9, or about 10 nM, or e.g., about 0.2 to about 5 nM, about 0.5 to about 2 nM, about 1 to 1.5 nM, about 0.1 to about 0.2 nM, about 0.2 to about 0.3 nM, about 0.3 to about 0.4 nM, or about 0.4 to about 0.5 nM, e.g., about 0.5 to about 0.6 nM, about 0.6 to about 0.7 nM, about 0.7 to about 0.8 nM, about 0.8 to about 0.9 nM, about 0.9 to about 1 nM, about 1 to about 1.5 nM, about 1.5 to about 2 nM, about 2.5 to about 3 nM, about 3.5 to about 4 nM, about 4 to about 4.5 nM, about 4.5 to about 5 nM, about 5 to about 6 nM, about 6 to about 7 nM, about 7 to about 8 nM, about 8 to about 9 nM, or about 9 to about 10 nM, or e.g., greater than about 0.1, about 0.2. about 0.3, about 0.4, about 0.5, about 0.6, about 0.7, about 0.8, about 0.9, about 1, about 2, about 3, about 4, about 5, about 6, about 7, about 8, about 9, or about 10 nM, e.g., as determined by surface plasmon resonance (e.g. Biacore) and/or bio-layer interferometry (e.g., Octet binding).

In an embodiment, the IL-2 fusion protein has altered (e.g., reduced or decreased) binding capacity and/or binding affinity for human CD132 in vitro and/or in vivo, relative to an IL-2 fusion protein comprising a wild-type IL-2 or a reference IL-2 fusion protein. In an embodiment, the IL-2 fusion protein has reduced or decreased binding capacity and/or binding affinity for human CD132 relative to an IL-2 fusion protein comprising a wild-type IL-2. In an embodiment, the IL-2 fusion protein has reduced or decreased binding capacity and/or binding affinity for human CD132 relative to a reference IL-2 fusion protein. In an embodiment, the binding capacity and/or binding affinity of the IL-2 fusion protein for human CD132 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 fusion protein for human CD132 is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has altered (e.g., reduced or decreased) binding capacity and/or binding affinity for the human dimeric IL-2 receptor comprising human CD122 and human CD132 in vitro and/or in vivo, relative to an IL-2 fusion protein comprising a wild-type IL-2 or a reference IL-2 fusion protein. In an embodiment, the IL-2 fusion protein has reduced or decreased binding capacity and/or binding affinity for the human dimeric IL-2 receptor comprising human CD122 and human CD132 relative to an IL-2 fusion protein comprising a wild-type IL-2. In an embodiment, the IL-2 fusion protein has reduced or decreased binding capacity and/or binding affinity for the human dimeric IL-2 receptor comprising human CD122 and human CD132 relative to a reference IL-2 fusion protein. In an embodiment, the binding capacity and/or binding affinity of the IL-2 fusion protein for the human dimeric IL-2 receptor comprising human CD122 and human CD132 is decreased by about 1%, 5%, 10%, 20%, 30%, 40%, 50%, 60%, 70%, 80%, 90%, 95%, or about 100%, or more. In an embodiment, the binding capacity and/or binding affinity of the IL-2 fusion protein for the human dimeric IL-2 receptor comprising human CD122 and human CD132 is decreased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has altered (e.g., enhanced, increased, and/or selective) binding to Tregs in vitro and/or in vivo, relative to an IL-2 fusion protein comprising a wild-type IL-2 or a reference IL-2 fusion protein. In an embodiment, the IL-2 fusion protein has enhanced or increased binding to Tregs relative to an IL-2 fusion protein comprising a wild-type IL-2. In an embodiment, the IL-2 fusion protein has selective binding to Tregs relative to IL-2 (e.g., wild type human IL-2). In an embodiment, the IL-2 fusion protein has enhanced or increased binding to Tregs relative to a reference IL-2 fusion protein. In an embodiment, the IL-2 fusion protein has selective binding to Tregs relative to a reference IL-2 fusion protein. In an embodiment, the binding to Tregs is increased by about 1%, 5%, 10%, 20%, 30%, 40%, 50%, 60%, 70%, 80%, 90%, 95%, or about 100%, or more. In an embodiment, the binding to Tregs is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has reduced or decreased binding affinity for CD122/CD132 heterodimer (e.g., human CD122/CD132 heterodimer), e.g., decreased by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein e.g., as determined by yeast surface display, surface plasmon resonance (e.g. Biacore) and/or bio-layer interferometry (e.g. Octet binding).

In an embodiment, the IL-2 fusion protein binds to CD122/CD132 heterodimer (e.g., human CD122/CD132 heterodimer) with low affinity, e.g., with a dissociation constant ($K_D$) of about 0.2-20 nM, e.g., about 0.2, about 0.3, about 0.4, about 0.5, about 0.6, about 0.7, about 0.8, about 0.9, about 1, about 1.1, about 1.2, about 1.3, about 1.4. about 1.5, about 2, about 3, about 4, about 5, about 6, about 7, about 8, about 9, about 10, about 11, about 12, about 13, about 14, about 15, about 16, about 17, about 18, or about 20 nM, or e.g., about 0.5 to about 15 nM, about 1 to about 10 nM, about 2 to about 5 nM, about 0.2 to about 0.3 nM, about 0.3 to about 0.4 nM, about 0.4 to about 0.5 nM, about 0.5 to about 0.6 nM, about 0.6 to about 0.7 nM, about 0.7 to about 0.8 nM, about 0.8 to about 0.9 nM, about 0.9 to about 1 nM, about 1 to about 1.1 nM, about 1.1 to about 1.2 nM, about 1.2 to about 1.3 nM, about 1.3 to about 1.4 nM, about 1.4 to about 1.5 nM, about 1.5 to about 2 nM, about 2 to about 3 nM, about 3 to about 4 nM, about 4 to about 5 nM, about 5 to about 6 nM, about 6 to about 7 nM, about 7 to about 8 nM, about 8 to about 9 nM, about 9 to about 10 nM, about 10 to about 11 nM, about 11 to about 12 nM, about 12 to about 13 nM, about 13 to about 14 nM, about 14 to about 15 nM, about 15 to about 16 nM, about 16 to about 17 nM, about 17 to about 18 nM, about 18 to about 19 nM, or about 19 to about 20 nM, or e.g., greater than about 0.2, about 0.3, about 0.4, about 0.5, about 0.6, about 0.7, about 0.8, about 0.9, about 1, about 1.1, about 1.2, about 1.3, about 1.4. about 1.5, about 2, about 3, about 4, about 5, about 6, about 7, about 8, about 9, about 10, about 11, about 12, about 13, about 14, about 15, about 16, about 17, about 18, or about 20 nM, e.g., as determined by yeast surface display.

In an embodiment, the IL-2 fusion protein binds to CD122/CD132 heterodimer (e.g., human CD122/CD132 heterodimer) with low affinity, e.g., with a dissociation constant ($K_D$) of about 0.2-300 nM, e.g., about 0.2 nM, about 0.5 nM, about 1 nM, about 2 nM, about 5 nM, about 10 nM, about 15 nM, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about 190 nM, about 200 nM, about 210 nM, about 220 nM, about 230 nM, about 240 nM, about 250 nM, about 260 nM, about 270 nM, about 280 nM, about 290 nM, or about 300 nM, or e.g., about 0.5 to about 15 nM, about 1 to about 10 nM, about 2 to about 5 nM, about 0.2 nM to about 0.5 nM, about 0.5 nM to about 1 nM, about 1 to about 2 nM, about 2 nM to about 5 nM, about 5 nM to about 10 nM, about 10 nM to about 15 nM, about 15 nM to about 20 nM, about 20 nM to about 25 nM, about 25 to about 30 nM, about 30 nM to about 40 nM, about 40 nM to about 50 nM, about 50 to about 60 nM, about 60 to about 70 nM, about 70 nM to about 80 nM, about 80 nM to about 90 nM, about 90 nM to about 100 nM, about 100 nM to about 110 nM, about 110 nM to about 120 nM, about 120 nM to about 130 nM, about 130 nM to about 140 nM, about 140 nM to about 150 nM, about 150 nM to about 160 nM, about 160 nM to about 170 nM, about 170 nM to about 180 nM, about 180 nM to about 190 nM, about 190 nM to about 200 nM, about 200 nM to about 210 nM, about 210 nM to about 220 nM, about 220 nM to about 230 nM, about 230 nM to about 240 nM, about 240 nM to about 250 nM, about 250 nM to about 260 nM, about 260 nM to about 270 nM, about 270 nM to about 280 nM, about 280 nM to about 290 nM, or about 290 nM to about 300 nM, or e.g., greater than about 0.2, about 0.5, about 1, about 2, about 5, about 10, about 15, about 20 nM, about 25 nM, about 30 nM, about 40 nM, about 50 nM, about 60 nM, about 70 nM, about 80 nM, about 90 nM, about 100 nM, about 110 nM, about 120 nM, about 130 nM, about 140 nM, about 150 nM, about 160 nM, about 170 nM, about 180 nM, about 190 nM, about 200 nM, about 210 nM, about 220 nM, about 230 nM, about 240 nM, about 250 nM, about 260 nM, about 270 nM, about 280 nM, about 290 nM, or greater than about 300 nM, e.g., as determined by surface plasmon resonance (e.g. Biacore) and/or biolayer interferometry (e.g. Octet binding).

In an embodiment, the IL-2 fusion protein has altered (e.g., enhanced, increased, and/or selective) binding to Tregs in vitro and/or in vivo, relative to an IL-2 fusion protein comprising wild-type IL-2 or a reference IL-2 fusion protein. In an embodiment, the IL-2 fusion protein has enhanced or increased binding to Tregs relative to an IL-2 fusion protein comprising wild-type IL-2. In an embodiment, the IL-2 fusion protein has selective binding to Tregs relative to IL-2 (e.g., wild type human IL-2). In an embodiment, the IL-2 fusion protein has enhanced or increased binding to Tregs relative to a reference IL-2 fusion protein. In an embodiment, the IL-2 fusion protein has selective binding to Tregs relative to a reference IL-2 fusion protein. In an embodiment, the binding to Tregs is increased by about 1%, 5%, 10%, 20%, 30%, 40%, 50%, 60%, 70%, 80%, 90%, 95%, or about 100%, or more. In an embodiment, the binding to Tregs is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has altered (e.g., enhanced, increased, and/or selective) activation of the IL-2 signaling pathway in Tregs in vitro and/or in vivo, relative to an IL-2 fusion protein comprising a wild-type IL-2 or a reference IL-2 fusion protein. In an embodiment, the IL-2 fusion protein has enhanced or increased activation of the IL-2 signaling pathway in Tregs relative to an IL-2 fusion protein comprising a wild-type IL-2. In an embodiment, the IL-2 fusion protein has selective activation of the IL-2 signaling pathway in Tregs relative to an IL-2 fusion protein comprising a wild-type IL-2. In an embodiment, the IL-2 fusion protein has enhanced or increased activation of the IL-2 signaling pathway in Tregs relative to a reference IL-2 fusion protein. In an embodiment, the IL-2 fusion protein has selective activation of the IL-2 signaling pathway in Tregs relative to a reference IL-2 fusion protein. In an embodiment, the activation of the IL-2 signaling pathway in Tregs is increased by about 1%, 5%, 10%, 20%, 30%, 40%, 50%, 60%, 70%, 80%, 90%, 95%, or about 100%, or more. In an embodiment, the activation of the IL-2 signaling pathway in Tregs is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein selectively activates IL-2 signaling in T regulatory cells in vitro and/or in vivo, e.g., having an T helper EC50/Treg EC50 ratio greater than about 1, about 2, about 3, about 4, about 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 150, 200, 250, 300, 350, 400, 450, 500, 600, 700, 800, 900, 1000, 1500, 2000, 2500, or about 3000 or more relative to an IL-2 fusion protein comprising a wild-type IL-2 or a reference IL-2 fusion protein e.g., as determined flow cytometry.

In an embodiment, the IL-2 fusion protein selectively activates IL-2 signaling in T regulatory cells in vitro and/or in vivo, e.g., having an NK cell EC50/Treg EC50 ratio greater than e.g., about 1, about 2, about 3, about 4, about 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, 55, 60, 65, 70, 75, 80, 85, 90, 95, 100, 150, 200, 250, 300, 350, 400, 450, 500, 600, 700, 800, 900, 1000, 1500, 2000, 2500, or about 3000 or more, or e.g., greater than 1 and about 1 to 2, about 2 to 3, about 3 to 4, about 4 to 5, greater than 1 and about 1 to 10, greater than 1 and about 1 to 20, greater than 1 and about 1 to 30, greater than 1 and about 1 to 40, greater than 1 and about 1 to 50, about 2 to 10, about 2 to 20, about 2 to 30, about 2 to 40, 2 to 50, about 5 to 10, about 5 to 20, about 5 to 30, about 5 to 40, about 5 to 50, about 10 to 20, about 10 to 30, about 10 to 40 about 10 to 50, about 20 to 40, about 20 to 50, about 50 to 100, about 100 to 200, about 200 to 500, about 500 to 1000, about 1000 to 2000, or about 1000 to 3000, relative to an IL-2 fusion protein comprising a wild-type IL-2 or a reference IL-2 fusion protein e.g., as determined flow cytometry.

In an embodiment, the IL-2 fusion protein has altered (e.g., enhanced, increased, and/or selective) ability to induce or promote Treg expansion, activity, survival, and/or proliferation in vitro and/or in vivo, relative to an IL-2 fusion protein comprising a wild-type IL-2 or a reference IL-2 fusion protein. In an embodiment, the IL-2 fusion protein has enhanced or increased ability to induce or promote Treg expansion, activity, survival, and/or proliferation relative to an IL-2 fusion protein comprising a wild-type IL-2. In an embodiment, the IL-2 fusion protein has selective ability to induce or promote Treg expansion, activity, survival, and/or proliferation relative to an IL-2 fusion protein comprising a wild-type IL-2. In an embodiment, the IL-2 fusion protein has enhanced or increased ability to induce or promote Treg expansion, activity, survival, and/or proliferation relative to a reference IL-2 fusion protein. In an embodiment, the IL-2 fusion protein has selective ability to induce or promote Treg expansion, activity, survival, and/or proliferation relative to a reference IL-2 fusion protein. In an embodiment, the ability to induce or promote Treg expansion, activity, survival, and/or proliferation is increased by about 1%, 5%, 10%, 20%, 30%, 40%, 50%, 60%, 70%, 80%, 90%, 95%, or about 100%, or more. In an embodiment, the ability to induce or promote Treg expansion, activity, survival, and/or proliferation is increased by about 0.5-fold, 1-fold, 2-fold, 3-fold, 4-fold, 5-fold, 6-fold, 7-fold, 8-fold, 9-fold, or about 10-fold, or more.

In an embodiment, the IL-2 fusion protein has enhanced or increased potency and/or ability to induce or promote T regulatory cell activity, e.g., having an EC50 for Tregs that is lower by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold or more e.g., relative to an IL-2 fusion protein comprising a wild-type IL-2 or a reference IL-2 fusion protein e.g., as determined flow cytometry.

In an embodiment, the IL-2 fusion protein has reduced or decreased potency and/or ability to induce or promote T regulatory cell activity, e.g., having an EC50 for Tregs that is higher by about 1%, about 2%, about 3%, about 4%, about 5%, about 10%, about 15%, about 20%, about 25%, about 30%, about 35%, about 40%, about 45%, about 50%, about 55%, about 60%, about 65%, about 70%, about 75%, about 80%, about 85%, about 90%, about 95%, or about 100% or more, or e.g., decreased by about 0.5-fold, about 1-fold, about 1.5-fold, about 2-fold, about 2.5-fold, about 3-fold, about 3.5-fold, about 4-fold, about 4.5-fold, about 5-fold, about 5.5-fold, about 6-fold, about 6.5-fold, about 7-fold, about 7.5-fold, about 8-fold, about 8.5-fold, about 9-fold, about 9.5-fold, about 10-fold, about 50-fold, about 100-fold, about 200-fold, about 500-fold, about 1000-fold, about 2000-fold, about 5000-fold, about 10,000, about 15,000-fold, or about 20,000-fold or more e.g., relative to an IL-2 fusion protein comprising a wild-type IL-2 or a reference IL-2 fusion protein e.g., as determined flow cytometry.

In an embodiment, the T helper cell described herein is a CD45+CD3+CD4+Foxp3− cell, e.g., determined by flow cytometry. In an embodiment, the Treg described herein is CD45+CD3+CD4+Foxp3+ cell, e.g., determined by flow cytometry. In an embodiment, the NK cell described herein is a CD45+CD3− cell that is CD56+ and/or CD16+, e.g., determined by flow cytometry. In an embodiment, the NK cell described herein is a CD45+CD3-CD56+ cell, e.g., determined by flow cytometry.

In an embodiment, the IL-2 fusion protein has one or more of the same, or substantially the same, structural and/or functional properties, as an IL-2 fusion protein comprising a wild-type IL-2 or a reference IL-2 fusion protein.

In an embodiment, the reference IL-2 fusion protein comprises an amino acid sequence that has about 75%, 80%, 85%, 90%, 91%, 92%, 93%, 94%, 95%, 96%, 97%, 98%, 99%, or more sequence identity to an IL-2 fusion protein described herein. In an embodiment, the reference IL-2 fusion protein comprises an IL-2 variant comprising the amino acid sequence of SEQ ID NO: 57. In an embodiment, the IL-2 fusion protein comprises an amino acid sequence that is at least 80%, 85%, 90%, 95%, or 98% identical to the amino acid sequence of SEQ ID NO: 57 and comprises one or more (2, 3, 4, 5, 6, 7, 8, 9, 10, or more) amino acid alterations (e.g., substitutions) described herein.

In an embodiment, the IL-2 fusion protein comprises an IL-2 polypeptide (e.g., a human IL-2 polypeptide) described herein. In an embodiment, the IL-2 fusion protein is encoded by a nucleic acid comprising a nucleotide sequence described herein.

In an embodiment, the IL-2 fusion protein comprises an amino acid alteration (e.g., substitution) at one or more (e.g., 2, 3, 4, 5, 6, 7, 8, 9, 10, 11, 12, 13, 14, or all) of positions in IL-2, as described herein. In an embodiment, the IL-2 fusion protein comprises an amino acid alteration (e.g., substitution) at one or more (e.g., 2, 3, 4, 5, 6, 7, 8, 9, 10, 11, 12, 13, 14, or all) of positions chosen from T3, H16, I28, K35, R38, F42, E68, V69, Q74, D84, S87, N88, I92, C125, or Q126 in IL-2.

In an embodiment, the IL-2 fusion protein comprises an amino acid alteration (e.g., substitution) at position T3 in IL-2. In an embodiment, the IL-2 fusion protein comprises an amino acid alteration (e.g., substitution) at position H16 in IL-2. In an embodiment, the IL-2 fusion protein comprises an amino acid alteration (e.g., substitution) at position 128 in IL-2. In an embodiment, the IL-2 fusion protein comprises an amino acid alteration (e.g., substitution) at position K35 in IL-2. In an embodiment, the IL-2 fusion protein comprises an amino acid alteration (e.g., substitution) at position R38 in IL-2. In an embodiment, the IL-2 fusion protein comprises an amino acid alteration (e.g., substitution) at position F42 in IL-2. In an embodiment, the IL-2 fusion protein comprises an amino acid alteration (e.g., substitution) at position E68 in IL-2. In an embodiment, the IL-2 fusion protein comprises an amino acid alteration (e.g., substitution) at position V69 in IL-2. In an embodiment, the IL-2 fusion protein comprises an amino acid alteration (e.g., substitution) at position Q74 in IL-2. In an embodiment, the IL-2 fusion protein comprises an amino acid alteration (e.g., substitution) at position D84 in IL-2. In an embodiment, the IL-2 fusion protein comprises an amino acid alteration (e.g., substitution) at position S87 in IL-2. In an embodiment, the IL-2 fusion protein comprises an amino acid alteration (e.g., substitution) at position N88 in IL-2. In an embodiment, the IL-2 fusion protein comprises an amino acid alteration (e.g., substitution) at position I92 in IL-2. In an embodiment, the IL-2 fusion protein comprises an amino acid alteration (e.g., substitution) at position C125 in IL-2. In an embodiment, the IL-2 fusion protein comprises an amino acid alteration (e.g., substitution) at position Q126 in IL-2.

In an embodiment, the IL-2 fusion protein comprises an amino acid alteration (e.g., substitution) at position V69, Q74, or both, in IL-2. In an embodiment, the IL-2 fusion protein comprises an amino acid alteration (e.g., substitution) at positions V69 and Q74 in IL-2. In an embodiment, the IL-2 fusion protein comprises the amino acid substitution V69A in IL-2. In an embodiment, the IL-2 fusion protein comprises the amino acid substitution Q74P in IL-2.

In an embodiment, the IL-2 fusion protein comprises an amino acid alteration (e.g., substitution) at position H16, I92, D84, or a combination thereof, in IL-2. In an embodiment, the IL-2 fusion protein comprises an amino acid alteration (e.g., substitution) at position H16, optionally wherein the amino acid substitution is H16N, H16L, or H16D, in IL-2. In an embodiment, the IL-2 fusion protein comprises the amino acid substitution H16N in IL-2. In an embodiment, the IL-2 fusion protein comprises the amino acid substitution H16L in IL-2. In an embodiment, the IL-2 fusion protein comprises the amino acid substitution H16D in IL-2.

In an embodiment, the IL-2 fusion protein comprises an amino acid alteration (e.g., substitution) at position at I92, optionally wherein the amino acid substitution is I92S, in IL-2. In an embodiment, the IL-2 fusion protein comprises the amino acid substitution I92S in IL-2.

In an embodiment, the IL-2 fusion protein comprises an amino acid alteration (e.g., substitution) at position D84, optionally wherein the amino acid substitution is D84V, in IL-2. In an embodiment, the IL-2 fusion protein comprises the amino acid substitution is D84V in IL-2.

In an embodiment, the IL-2 fusion protein comprises an amino acid alteration (e.g., substitution) at position K35, R38, F42, E68, or a combination thereof, in IL-2. In an embodiment, the IL-2 fusion protein comprises an amino acid alteration (e.g., substitution) at position K35, optionally wherein the amino acid substitution is K35E, in IL-2. In an embodiment, IL-2 fusion protein comprises the amino acid substitution K35E in IL-2.

In an embodiment, the IL-2 fusion protein comprises an amino acid alteration (e.g., substitution) at position R38, optionally wherein the amino acid substitution is R38E, R38N or R38Q, in IL-2. In an embodiment, the IL-2 fusion protein comprises the amino acid substitution R38N in IL-2. In an embodiment, the IL-2 fusion protein comprises the amino acid substitution R38Q in IL-2.

In an embodiment, the IL-2 fusion protein comprises an amino acid alteration (e.g., substitution) at position F42, optionally wherein the amino acid substitution is F42K or F42Q, in IL-2. In an embodiment, the IL-2 fusion protein comprises the amino acid substitution F42K in IL-2. In an embodiment, the IL-2 fusion protein comprises the amino acid substitution F42Q in IL-2.

In an embodiment, the IL-2 fusion protein comprises an amino acid alteration (e.g., substitution): (i) at (a) positions V69 and Q74, (b) position K35, or (c) positions V69, Q74, and K35; and (ii) at one, two, or all of positions H16, I92, or D84, in IL-2. In an embodiment, the IL-2 fusion protein further comprises an amino acid alteration (e.g., substitution) at one, two, or all of positions R38, F42, or E68, in IL-2.

In an embodiment, the IL-2 fusion protein comprises an amino acid alteration (e.g., substitution): (i) at (a) positions V69 and Q74, (b) position K35, or (c) positions V69, Q74, and K35; and (ii) at (a) one, two, or all of positions H16, I92, or D84; or (b) one, two, or all of positions R38, F42, or E68, in IL-2.

In an embodiment, the IL-2 fusion protein comprises an amino acid alteration (e.g., substitution): (i) at (a) positions V69 and Q74, (b) position K35, or (c) positions V69, Q74, and K35; and (ii) at (a) one, two, or all of positions H16, I92, or D84; and (b) one, two, or all of positions R38, F42, or E68, in IL-2.

In an embodiment, the IL-2 fusion protein comprises an amino acid alteration (e.g., substitution) at position V69, Q74, and H16, optionally wherein the amino acid substitution is V69A, Q74P, and H16N or H16L, respectively, in IL-2. In an embodiment, the IL-2 fusion protein comprises the amino acid substitutions V69A, Q74P, and H16N or H16L, in IL-2. In an embodiment, the IL-2 fusion protein comprises the amino acid substitutions V69A, Q74P, and H16N, in IL-2. In an embodiment, the IL-2 fusion protein comprises the amino acid substitutions V69A, Q74P, and H16L, in IL-2.

In an embodiment, the IL-2 fusion protein comprises an amino acid alteration (e.g., substitution) at position V69, Q74, and I92, optionally wherein the amino acid substitution is V69A, Q74P, and I92S, respectively, in IL-2. In an embodiment, the IL-2 fusion protein comprises the amino acid substitutions V69A, Q74P, and I92S, in IL-2.

In an embodiment, the IL-2 fusion protein comprises an amino acid alteration (e.g., substitution) at position V69, Q74, and D84, optionally wherein the amino acid substitution is V69A, Q74P, and D84V, respectively, in IL-2. In an embodiment, the IL-2 fusion protein comprises the amino acid substitutions V69A, Q74P, and D84V, in IL-2.

In an embodiment, the IL-2 fusion protein comprises an amino acid alteration (e.g., substitution) at position V69, Q74, and R38, optionally wherein the amino acid substitution is V69A, Q74P, and R38Q, respectively, in IL-2. In an embodiment, the IL-2 fusion protein comprises the amino acid substitutions V69A, Q74P, and R38Q, in IL-2.

In an embodiment, the IL-2 fusion protein comprises an amino acid alteration (e.g., substitution) at position V69, Q74, and F42, optionally wherein the amino acid substitution is V69A, Q74P, and F42Q, respectively, in IL-2. In an embodiment, the IL-2 fusion protein comprises the amino acid substitutions V69A, Q74P, and F42Q, in IL-2.

In an embodiment, the IL-2 fusion protein comprises an amino acid alteration (e.g., substitution) at position V69, Q74, and R38, optionally wherein the amino acid substitution is V69A, Q74P, and R38N, respectively, in IL-2. In an embodiment, the IL-2 fusion protein comprises the amino acid substitutions V69A, Q74P, and R38N, in IL-2.

In an embodiment, the IL-2 fusion protein comprises an amino acid alteration (e.g., substitution) at position V69, Q74, and R38, optionally wherein the amino acid substitution is V69A, Q74P, and R38E, respectively, in IL-2. In an embodiment, the IL-2 fusion protein comprises the amino acid substitution V69A, Q74P, and R38E, in IL-2.

In an embodiment, the IL-2 fusion protein comprises an amino acid alteration (e.g., substitution) at position V69, Q74, K35, and H16, optionally wherein the amino acid substitution is V69A, Q74P, K35E, and H16N, respectively, in IL-2. In an embodiment, the IL-2 fusion protein comprises the amino acid substitutions V69A, Q74P, K35E, and H16N, in IL-2.

In an embodiment, the IL-2 fusion protein comprises an amino acid alteration (e.g., substitution) at position V69, Q74, K35, H16, and R38, optionally wherein the amino acid substitution is V69A, Q74P, K35E, H16N, and R38N, respectively, in IL-2. In an embodiment, the IL-2 fusion protein comprises the amino acid substitutions V69A, Q74P, K35E, H16N, and R38N, in IL-2.

In an embodiment, the IL-2 fusion protein comprises an amino acid alteration (e.g., substitution) at position V69, Q74, H16, and R38, optionally wherein the amino acid substitution is V69A, Q74P, H16N, and R38N or R38Q, respectively, in IL-2. In an embodiment, the IL-2 fusion protein comprises the amino acid substitutions V69A, Q74P, H16N, and R38N or R38Q, in IL-2. In an embodiment, the IL-2 fusion protein comprises the amino acid substitutions V69A, Q74P, H16N, and R38N, in IL-2. In an embodiment, the IL-2 fusion protein comprises the amino acid substitutions V69A, Q74P, H16N, and R38Q, in IL-2.

In an embodiment, the IL-2 fusion protein comprises an amino acid alteration (e.g., substitution) at position I28, E68, S87, N88, Q126, or a combination thereof, in IL-2.

In an embodiment, the IL-2 fusion protein comprises an amino acid alteration (e.g., substitution) at position I28, optionally wherein the amino acid substitution is I28T or I28F, in IL-2. In an embodiment, the IL-2 fusion protein comprises the amino acid substitution I28T in IL-2. In an embodiment, the IL-2 fusion protein comprises the amino acid substitution I28F in IL-2.

In an embodiment, the IL-2 fusion protein comprises an amino acid alteration (e.g., substitution) at position E68, optionally wherein the amino acid substitution is E68Q or E68N, in IL-2. In an embodiment, the IL-2 fusion protein comprises the amino acid substitution E68Q in IL-2. In an embodiment, the IL-2 fusion protein comprises the amino acid substitution E68N in IL-2.

In an embodiment, the IL-2 fusion protein comprises an amino acid alteration (e.g., substitution) at position S87, optionally wherein the amino acid substitution is S87R, in IL-2. In an embodiment, the IL-2 fusion protein comprises the amino acid substitution S87R in IL-2.

In an embodiment, the IL-2 fusion protein comprises an amino acid alteration (e.g., substitution) at position N88, optionally wherein the amino acid substitution is N88S, N88L, or N88D, in IL-2. In an embodiment, the IL-2 fusion protein comprises the amino acid substitution N88S, N88L, or N88D, in IL-2. In an embodiment, the IL-2 fusion protein comprises the amino acid substitution N88S in IL-2. In an embodiment, the IL-2 fusion protein comprises the amino acid substitution N88L in IL-2. In an embodiment, the IL-2 fusion protein comprises the amino acid substitution N88D in IL-2.

In an embodiment, the IL-2 fusion protein comprises an amino acid alteration (e.g., substitution) at position Q126, optionally wherein the amino acid substitution is Q126T, Q126K, or Q126R, in IL-2. In an embodiment, the IL-2 fusion protein comprises the amino acid substitution Q126T, Q126K, or Q126R, in IL-2. In an embodiment, the IL-2 fusion protein comprises the amino acid substitution Q126T, Q126K, or Q126R, in IL-2. In an embodiment, the IL-2 fusion protein comprises the amino acid substitution Q126T in IL-2. In an embodiment, the IL-2 fusion protein comprises the amino acid substitution Q126K in IL-2. In an embodiment, the IL-2 fusion protein comprises the amino acid substitution Q126R in IL-2.

In an embodiment, the IL-2 fusion protein comprises an amino acid alteration (e.g., substitution) at position C125 in IL-2, optionally wherein the amino acid substitution is C125S. In an embodiment, the IL-2 fusion protein comprises the amino acid substitution C125S in IL-2.

In an embodiment, the IL-2 fusion protein comprises an amino acid alteration (e.g., substitution) at position T3 in IL-2, optionally wherein the amino acid substitution is T3A. In an embodiment, the IL-2 fusion protein comprises the amino acid substitution T3A in IL-2.

In an embodiment, the IL-2 fusion protein comprises an amino acid alteration (e.g., substitution) at position V69, Q74, and C125, in IL-2, optionally wherein the amino acid substitution is V69A, Q74P, and C125S, respectively. In an embodiment, the IL-2 fusion protein comprises the amino acid substitutions V69A, Q74P, and C125S, in IL-2.

In an embodiment, the IL-2 fusion protein comprises an amino acid alteration (e.g., substitution) at position T3, H16, I92, in IL-2, or a combination thereof, optionally wherein the amino acid substitution is T3A, H16N, and I92S, in IL-2, respectively.

In an embodiment, the IL-2 fusion protein comprises an amino acid alteration (e.g., substitution) at position H16, V69, Q74, and C125, in IL-2, optionally wherein the amino acid substitution is H16N, V69A, Q74P, and C125S, in IL-2, respectively. In an embodiment, the IL-2 fusion protein comprises the amino acid substitutions H16N, V69A, Q74P, and C125S in IL-2.

In an embodiment, the IL-2 fusion protein comprises an amino acid alteration (e.g., substitution) at position H16, V69, Q74, and C125, in IL-2, optionally wherein the amino acid substitution is H16L, V69A, Q74P, and C125S, in IL-2, respectively. In an embodiment, the IL-2 fusion protein comprises the amino acid substitutions H16L, V69A, Q74P, and C125S, in IL-2.

In an embodiment, the IL-2 fusion protein comprises an amino acid alteration (e.g., substitution) at position H16, V69, Q74, I92, and C125, in IL-2, optionally wherein the amino acid substitution is H16L, V69A, Q74P, I92S, and C125S, in IL-2, respectively. In an embodiment, the IL-2 fusion protein comprises the amino acid substitutions H16L, V69A, Q74P, I92S, and C125S, in IL-2.

In an embodiment, the IL-2 fusion protein comprises an amino acid alteration (e.g., substitution) at position T3, V69, Q74, and C125, in IL-2, optionally wherein the amino acid substitution is T3A, V69A, Q74P, and C125S, in IL-2, respectively. In an embodiment, the IL-2 fusion protein comprises the amino acid substitutions T3A, V69A, Q74P, and C125S, in IL-2.

In an embodiment, the IL-2 fusion protein comprises an amino acid alteration (e.g., substitution) at position T3, H16, V69, Q74, and C125, in IL-2, optionally wherein the amino acid substitution is T3A, H16N or H16L, V69A, Q74P, and C125S, in IL-2, respectively. In an embodiment, the IL-2 fusion protein comprises the amino acid substitutions T3A, H16N, V69A, Q74P, and C125S. In an embodiment, the IL-2 fusion protein comprises the amino acid substitutions T3A, H16L, V69A, Q74P, and C125S, in IL-2.

In an embodiment, the IL-2 fusion protein comprises an amino acid alteration (e.g., substitution) at position T3, V69, Q74, I92, and C125, in IL-2, optionally wherein the amino acid substitution is T3A, V69A, Q74P, I92S, and C125S, in IL-2, respectively. In an embodiment, the IL-2 fusion protein comprises the amino acid substitutions T3A, V69A, Q74P, I92S, and C125S, in IL-2. In an embodiment, the IL-2 fusion protein comprises the amino acid substitutions T3A, V69A, Q74P, I92S, and C125S, in IL-2.

In an embodiment, the IL-2 fusion protein comprises an amino acid alteration (e.g., substitution) at position H16, K35, V69 and Q74, optionally wherein the amino acid substitution is H16L, K35E, V69A, and Q74P, respectively, in IL-2. In an embodiment, the IL-2 fusion protein comprises the amino acid substitutions H16L, K35E, V69A, and Q74P, in IL-2.

In an embodiment, the IL-2 fusion protein comprises an amino acid alteration (e.g., substitution) at position H16, R38, V69A, and Q74P, optionally wherein the amino acid substitution is H16L, R38Q, V69A, and Q74P, respectively, in IL-2. In an embodiment, the IL-2 fusion protein comprises the amino acid substitutions H16L, R38Q, V69A, and Q74P, in IL-2.

In an embodiment, the IL-2 fusion protein comprises the amino acid substitutions H16L, V69A, Q74P, and C125S, in IL-2.

Without wishing to be bound by theory, it is believed that in an embodiment, an IL-2 fusion protein comprising the amino acid substitutions H16L, V69A, Q74P, and C125S, can have at least one or more of the following advantageous properties: (i) has reduced binding affinity for CD122 and/or CD132, which increases the potency and selectivity of the IL-2 agent for regulatory T cells (Treg) compared to other T cell types; (ii) is significantly stable, e.g., due to the presence of stabilizing V69A and Q74P mutations; (iii) has reduced or decreased binding capacity and/or binding affinity for CD25, which improves the lifetime of the IL-2 agent; (iv) does not substantially promote expansion, activation, survival, and/or proliferation of T effector cells and/or natural killer (NK) cells in vitro and/or in vivo; and/or (v) has reduced incorrect disulfide pairing and improved stability, e.g., due to the presence of the C125S mutation. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 variant comprising the amino acid substitutions H16L, V69A, Q74P, and C125S particularly suitable for treating disorders and conditions arising from abnormal immune responses, such as autoimmune diseases.

Thus, in an embodiment, an IL-2 fusion protein comprising amino acid substitutions H16L, V69A, Q74P, and C125S, has inter alia one or more (e.g., 2, 3, 4, 5, 6, 7, or all) of the following properties relative to a wild-type IL-2 or a reference IL-2 variant that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 variant for the heterodimeric IL-2 receptor composed of human CD122 and human CD132 (i.e. human CD122/CD132 heterodimer) in vitro and/or in vivo; (v) reduced or decreased or substantially unchanged binding capacity and/or binding affinity for human CD25 in vitro and/or in vivo; (vi) selective binding to regulatory T cells (e.g. Foxp3+ T cells); (vii) selective activation of the IL-2 signaling pathway in T regulatory cells (Tregs) in vitro or in vivo; or (viii) enhanced or increased ability to induce or promote Treg expansion, activity, survival and/or proliferation.

In an embodiment, the IL-2 fusion protein comprises an IL-2 variant comprising an amino acid sequence chosen from: SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an IL-2 variant comprising the amino acid sequence of SEQ ID NO: 4, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises an IL-2 variant comprising the amino acid sequence of SEQ ID NO: 5, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 11, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1000, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1001, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises the amino acid sequence of any of SEQ ID NOs: 4, 5, 11, 1000, 1001, or 1002, or a functional fragment thereof. In an embodiment, the IL-2 fusion protein comprises the amino acid sequence of SEQ ID NO: 4 or 5, or a functional fragment thereof. In an embodiment, the IL-2 fusion protein comprises the amino acid sequence of SEQ ID NO: 4, or a functional fragment thereof. In an embodiment, the IL-2 fusion protein comprises the amino acid sequence of SEQ ID NO: 5, or a functional fragment thereof. In an embodiment, the IL-2 fusion protein comprises the amino acid sequence of SEQ ID NO: 11, or a functional fragment thereof. In an embodiment, the IL-2 fusion protein comprises the amino acid sequence of SEQ ID NO: 1000, or a functional fragment thereof. In an embodiment, the IL-2 fusion protein comprises the amino acid sequence of SEQ ID NO: 1001, or a functional fragment thereof. In an embodiment, the IL-2 fusion protein comprises the amino acid sequence of SEQ ID NO: 1002, or a functional fragment thereof.

Without wishing to be bound by theory, it is believed that in an embodiment, an IL-2 fusion protein comprising the amino acid sequence of SEQ ID NO: 5, or a functional fragment thereof, can have at least one or more of the following advantageous properties: (i) has reduced binding affinity for CD122 and/or CD132, which increases the potency and selectivity of the IL-2 agent for regulatory T cells (Treg) compared to other T cell types; (ii) is significantly stable, e.g., due to the presence of stabilizing V69A and Q74P mutations; (iii) has reduced or decreased binding capacity and/or binding affinity for CD25, which improves the lifetime of the IL-2 agent; (iv) does not substantially promote expansion, activation, survival, and/or proliferation of T effector cells and/or natural killer (NK) cells in vitro and/or in vivo; and/or (v) has reduced incorrect disulfide pairing and improved stability, e.g., due to the presence of the C125S mutation. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 fusion protein comprising the amino acid sequence of SEQ ID NO: 5 particularly suitable for treating disorders and conditions arising from abnormal immune responses, such as autoimmune diseases.

Thus, in an embodiment, an IL-2 fusion protein comprising the amino acid sequence SEQ ID NO: 5, or a functional fragment thereof, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto, has inter alia one or more (e.g., 2, 3, 4, 5, 6, 7, or all) of the following properties relative to a wild-type IL-2 or a reference IL-2 fusion protein that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 fusion protein for the heterodimeric IL-2 receptor composed of human CD122 and human CD132 (i.e. human CD122/CD132 heterodimer) in vitro and/or in vivo; (v) reduced or decreased or substantially unchanged binding capacity and/or binding affinity for human CD25 in vitro and/or in vivo; (vi) selective binding to regulatory T cells (e.g. Foxp3+ T cells); (vii) selective activation of the IL-2 signaling pathway in T regulatory cells (Tregs) in vitro or in vivo; or (viii) enhanced or increased ability to induce or promote Treg expansion, activity, survival and/or proliferation.

In an embodiment, the IL-2 fusion proteins described herein comprise an Fc region, e.g. an Fc region having one or more mutations described herein, and/or having one or more structural or functional properties described herein. Without wishing to be bound by theory, it is believed that in an embodiment, the Fc regions described herein can reduce (e.g., prevent) renal clearance and/or extend half-life of the IL-2 agents (e.g., via FcRn).

As used herein, the term "fusion protein" refers to a protein, comprising two or more protein or peptide components. The two or more protein or peptide components can be obtained from different sources or encoded by different genes. A fusion protein is sometimes also referred to as a chimeric protein. An Fc fusion protein (also known as Fc chimeric fusion protein, Fc-Ig, Ig-based chimeric fusion protein, or Fc-tag protein) can include an Fc region of an immunoglobulin (e.g., an Fc region described herein) linked (e.g., fused) to a protein or peptide. The Fc region can be linked (e.g., fused genetically) to the protein or peptide directly, or indirectly, e.g., through a linker. In an embodiment, the Fc region is derived from the Fc region of IgG, e.g., human IgG, e.g., IgG1, IgG2, IgG3, or IgG4. In an embodiment, the Fc region is derived from the Fc region of IgG1, e.g., human IgG1.

An IL-2 fusion protein can include an IL-2 variant (e.g., an IL-2 variant described herein), or a functional fragment thereof, linked (e.g., fused) to a protein or peptide. In an embodiment, the IL-2 fusion protein is an IL-2-Fc fusion protein, e.g., further comprising an Fc region of an immunoglobulin (e.g., an Fc region described herein) linked (e.g., fused) to the IL-2 polypeptide (e.g., an IL-2 variant described herein) or a functional fragment thereof. In an embodiment, the IL-2 fusion protein is not an IL-2-Fc fusion protein, e.g., an IL-2 fusion variant described herein, or a functional fragment thereof, is linked (e.g., fused) to a protein or peptide other than an Fc region of IgG, e.g., human IgG, e.g., IgG1, IgG2, IgG3, or IgG4.

In an embodiment, the IL-2 fusion protein comprises an amino acid sequence chosen from: SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO: 102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, or SEQ ID NO: 131, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, or SEQ ID NO: 169, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, or SEQ ID NO: 207, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, or SEQ ID NO: 245, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, or SEQ ID NO: 283, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, or SEQ ID NO: 321, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, or SEQ ID NO: 359, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 fusion protein comprises an amino acid sequence chosen from: 1004, SEQ ID NO: 1005, SEQ ID NO: 1006, SEQ ID NO: 1007, SEQ ID NO: 1008, SEQ ID NO: 1009 or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1004, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1005, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1006, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1007, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto. In an embodiment, the IL-2 fusion protein comprises the amino acid sequence of SEQ ID NO: 1008, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 agent comprises the amino acid sequence of any of SEQ ID NOs: 1004-1009, or a functional fragment thereof. In an embodiment, the IL-2 agent comprises the amino acid sequence of SEQ ID NO: 1007 or 1008, or a functional fragment thereof. In an embodiment, the IL-2 agent comprises the amino acid sequence of SEQ ID NO: 1004, or a functional fragment thereof. In an embodiment, the IL-2 agent comprises the amino acid sequence of SEQ ID NO: 1005, or a functional fragment thereof. In an embodiment, the IL-2 agent comprises the amino acid sequence of SEQ ID NO: 1006, or a functional fragment thereof. In an embodiment, the IL-2 agent comprises the amino acid sequence of SEQ ID NO: 1007, or a functional fragment thereof. In an embodiment, the IL-2 agent comprises the amino acid sequence of SEQ ID NO: 1008, or a functional fragment thereof. In an embodiment, the IL-2 agent comprises the amino acid sequence of SEQ ID NO: 1009, or a functional fragment thereof.

Without wishing to be bound by theory, it is also believed that in an embodiment, an IL-2 fusion protein comprising the amino acid sequence of SEQ ID NO: 1008, or a functional fragment thereof, can have at least one or more of the following advantageous properties: (i) has reduced binding affinity for CD122 and/or CD132, which increases the potency and selectivity of the IL-2 agent for regulatory T cells (Treg) compared to other T cell types; (ii) is significantly stable, e.g., due to the presence of stabilizing V69A and Q74P mutations; (iii) has reduced or decreased binding capacity and/or binding affinity for CD25, which improves the lifetime of the IL-2 agent; (iv) does not substantially promote expansion, activation, survival, and/or proliferation of T effector cells and/or natural killer (NK) cells in vitro and/or in vivo; (v) has reduced incorrect disulfide pairing and improved stability, e.g., due to the presence of the C125S mutation; and/or (vi) has reduced effector function, e.g., by reduced Fc glycosylation due to the N297G mutation in the Fc region. In an embodiment, an IL-2 agent comprising the H16L mutation has reduced binding affinity for CD122 and/or CD132 and/or increased potency and selectivity for Treg over other T cell types, compared to an IL-2 agent comprising other H16 mutations. These properties make an IL-2 fusion protein comprising the amino acid sequence of SEQ ID NO: 1008 particularly suitable for treating disorders and conditions arising from abnormal immune responses, such as autoimmune diseases.

Thus, in an embodiment, an IL-2 fusion protein comprising the amino acid sequence SEQ ID NO: 1008, or a functional fragment thereof, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, 30, 35, 40, 45, or 50 amino acids thereto, has inter alia one or more (e.g., 2, 3, 4, 5, 6, 7, 8, or all) of the following properties relative to a wild-type IL-2 or a reference IL-2 fusion protein that does not comprise the amino acid substitutions: (i) enhanced or increased stability in vitro or in vivo; (ii) reduced or decreased binding capacity and/or binding affinity for human CD122 in vitro and/or in vivo; (iii) reduced or decreased binding capacity and/or binding affinity for human CD132 in vitro and/or in vivo; (iv) reduced or decreased affinity of the IL-2 fusion protein for the heterodimeric IL-2 receptor composed of human CD122 and human CD132 (i.e. human CD122/CD132 heterodimer) in vitro and/or in vivo; (v) reduced or decreased or substantially unchanged binding capacity and/or binding affinity for human CD25 in vitro and/or in vivo; (vi) selective binding to regulatory T cells (e.g. Foxp3+ T cells); (vii) selective activation of the IL-2 signaling pathway in T regulatory cells (Tregs) in vitro or in vivo; (viii) enhanced or increased ability to induce or promote Treg expansion, activity, survival and/or proliferation; or (ix) reduced or decreased effector function.

In an embodiment, the IL-2 fusion protein comprises from N-terminus to C-terminus an IL-2 variant described herein and an Fc region (e.g., Fc region described herein). In an embodiment, the fusion protein further comprises a linker (e.g., a linker described herein) between the IL-2 variant and the Fc region. In an embodiment the IL-2 fusion forms a dimer, e.g., a homodimer.

In an embodiment, the fusion protein comprises one or more glycosylation sites, or is glycosylated. In another embodiment, the fusion protein does not have a glycosylation site, or is not glycosylated.

In an embodiment, the only amino acids in the fusion protein are canonical amino acids. In an embodiment, the fusion protein comprises naturally-occurring amino acids; analogs, derivatives and congeners thereof; amino acid analogs having variant side chains; and/or all stereoisomers of any of any of the foregoing. The fusion protein may comprise the D- or L-optical isomers of amino acids and peptidomimetics.

In an aspect, this disclosure provides a method of making an IL-2 fusion protein disclosed herein. The IL-2 fusion proteins described herein can be produced by any suitable recombinant DNA technique. In an embodiment, the method includes culturing a cell containing a nucleic acid encoding the IL-2 fusion protein under conditions that allow production of the fusion protein. In another embodiment, the method further includes isolating or purifying the IL-2 fusion protein. In yet another embodiment, the method further includes evaluating efficacy of the IL-2 fusion protein in a cell-based assay or in an animal model. In still another embodiment, the method further includes administering the IL-2 fusion protein to a subject, e.g., a human.

This disclosure provides an isolated nucleic acid molecule encoding an IL-2 fusion protein described herein, and vectors and host cells thereof. The nucleic acid molecule includes, but is not limited to, RNA, genomic DNA and cDNA.

IL-2 Complexes

In an embodiment, the IL-2 agent comprises an IL-2 complex, e.g., an IL-2 complex described herein. In an embodiment, the IL-2 complex is an IL-2/anti-IL-2 antibody immune complex (IL-2 ic).

Without wishing to be bound by theory, it is believed that in an embodiment, IL-2 complexes, such as IL-2/anti-IL-2 antibody immune complexes, can potentiate biologic activity of IL-2 in vivo. For example, the effect of IL-2 on cells (e.g., Tregs) can be modulated by complexing IL-2 with distinct mAbs that specifically bind IL-2. The mechanisms can include, e.g., the prolongation of the cytokine half-life in circulation. Depending on the clone of IL-2 antibody, IL-2 ic can selectively stimulate, for example, CD25high cells (e.g., IL-2/JES6-1 immune complexes), or CD122high cells (e.g., IL-2/S4B6 immune complexes). For example, IL-2/JES6-1 immune complexes highly selectively stimulate regulatory T cells and they can be useful for transplantations and in treatment of autoimmune diseases. As another example, IL-2/S4B6 immune complexes can have high stimulatory activity for NK cells and memory CD8+ T cells and they can replace the conventional IL-2 in cancer immunotherapy.

In an embodiment, the IL-2 complex comprises an IL-2 variant described herein. In an embodiment, the IL-2 complex comprises one or more amino acid alterations (e.g., substitutions) described in Table 9. In an embodiment, the IL-2 complex comprises an amino acid sequence described in Table 9, or a functional fragment thereof. In an embodiment, the IL-2 complex comprises an anti-IL-2 antibody molecule. In an embodiment, the IL-2 complex comprises an IL-2 variant described herein and an anti-IL-2 antibody molecule. In an embodiment, the anti-IL-2 antibody molecule binds to the IL-2 variant. In an embodiment, the anti-IL-2 antibody molecule is capable of binding to the IL-2 variant and the wild-type IL-2. In an embodiment, the IL-2 variant comprises one or more mutations described herein. In an embodiment, the one or more mutations does not reduce, or does not substantially reduce, binding of the IL-2 variant to an anti-IL-2 antibody molecule.

In an embodiment, the IL-2 complex comprises an amino acid sequence chosen from: SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 complex modulates (e.g., stimulates) one or more activities of T cells. In an embodiment, the IL-2 complex stimulates CD25high cells. In an embodiment, the IL-2 complex stimulates Tregs. In an embodiment, the IL-2 complex stimulates CD122high cells. In an embodiment, the IL-2 complex stimulates NK cells and/or memory CD8+ T cells. In an embodiment, the IL-2 complex selectively stimulates CD25high cells over CD122high cells. In an embodiment, the IL-2 complex selectively stimulates CD122high cells over CD25high cells. In an embodiment, the IL-2 complex selectively stimulates Tregs over NK cells and/or memory CD8+ T cells. In an embodiment, the IL-2 complex selectively stimulates NK cells and/or memory CD8+ T cells over Tregs.

Exemplary anti-IL-2 antibody molecules suitable for use are described, e.g., in International Application Publication No. WO 2016/164937, which is incorporated herein by reference in its entirety.

As used herein, the term "antibody molecule" refers to a protein, e.g., an immunoglobulin chain or a fragment thereof, comprising at least one immunoglobulin variable domain sequence. The term "antibody molecule" includes, for example, full-length, mature antibodies and antigen-binding fragments of an antibody. For example, an antibody molecule can include a heavy (H) chain variable domain sequence (abbreviated herein as VH), and a light (L) chain variable domain sequence (abbreviated herein as VL). In another example, an antibody molecule includes two heavy (H) chain variable domain sequences and two light (L) chain variable domain sequence, thereby forming two antigen binding sites, such as Fab, Fab', F(ab')2, Fc, Fd, Fd', Fv, single chain antibodies (scFv for example), single variable domain antibodies, diabodies (Dab) (bivalent and bispecific), and chimeric (e.g., humanized) antibodies, which may be produced by the modification of whole antibodies or those synthesized de novo using recombinant DNA technologies. These functional antibody fragments retain the ability to selectively bind with their respective antigen or receptor. Antibodies and antibody fragments can be from any class of antibodies including, but not limited to, IgG, IgA, IgM, IgD, and IgE, and from any subclass (e.g., IgG1, IgG2, IgG3, and IgG4) of antibodies. The antibody molecules can be monoclonal or polyclonal. The antibody molecule can also be a human, humanized, CDR-grafted, or in vitro generated antibody. The antibody molecule can have a heavy chain constant region chosen from, e.g., IgG1, IgG2, IgG3, or IgG4. The antibody molecule can also have a light chain chosen from, e.g., kappa or lambda. The term "immunoglobulin" (Ig) is used interchangeably with the term "antibody" herein.

Examples of antigen-binding fragments include: (i) a Fab fragment, a monovalent fragment consisting of the VL, VH, CL and CH1 domains; (ii) a F(ab')2 fragment, a bivalent fragment comprising two Fab fragments linked by a disulfide bridge at the hinge region; (iii) a Fd fragment consisting of the VH and CH1 domains; (iv) a Fv fragment consisting of the VL and VH domains of a single arm of an antibody, (v) a diabody (dAb) fragment, which consists of a VH domain; (vi) a camelid or camelized variable domain; (vii) a single chain Fv (scFv), see e.g., Bird et al. (1988) *Science* 242:423-426; and Huston et al. (1988) *Proc. Natl. Acad. Sci. USA* 85:5879-5883); (viii) a single domain antibody. These antibody fragments may be obtained using any suitable method, including several conventional techniques known to those with skill in the art, and the fragments can be screened for utility in the same manner as are intact antibodies.

The term "antibody" includes intact molecules as well as functional fragments thereof. Constant regions of the antibodies can be altered, e.g., mutated, to modify the properties of the antibody (e.g., to increase or decrease one or more of: Fc receptor binding, antibody glycosylation, the number of cysteine residues, effector cell function, or complement function).

The antibody molecule can be a single chain antibody. A single-chain antibody (scFV) may be engineered (see, for example, Colcher, D. et al. (1999) *Ann N Y Acad Sci* 880:263-80; and Reiter, Y. (1996) *Clin Cancer Res* 2:245-52). The single chain antibody can be dimerized or multimerized to generate multivalent antibodies having specificities for different epitopes of the same target protein.

The antibody molecules disclosed herein can also be single domain antibodies. Single domain antibodies can include antibodies whose complementary determining regions are part of a single domain polypeptide. Examples include, but are not limited to, heavy chain antibodies, antibodies naturally devoid of light chains, single domain antibodies derived from conventional 4-chain antibodies, engineered antibodies and single domain scaffolds other than those derived from antibodies. Single domain antibodies may be any of the art, or any future single domain antibodies. Single domain antibodies may be derived from any species including, but not limited to mouse, human, camel, llama, fish, shark, goat, rabbit, and bovine. According to some aspects, a single domain antibody is a naturally occurring single domain antibody known as heavy chain antibody devoid of light chains. Such single domain antibodies are disclosed in WO 94/04678, for example. For clarity reasons, this variable domain derived from a heavy chain antibody naturally devoid of light chain is known herein as a VHH or nanobody to distinguish it from the conventional VH of four chain immunoglobulins. Such a VHH molecule can be derived from antibodies raised in Camelidae species, for example in camel, llama, dromedary, alpaca and guanaco. Other species besides Camelidae may produce heavy chain antibodies naturally devoid of light chain; such VHHs are also contemplated.

The VH and VL regions can be subdivided into regions of hypervariability, termed "complementarity determining regions" (CDR), interspersed with regions that are more conserved, termed "framework regions" (FR or FW). The terms "complementarity determining region," and "CDR," as used herein refer to the sequences of amino acids within antibody variable regions which confer antigen specificity and binding affinity. As used herein, the terms "framework," "FW" and "FR" are used interchangeably.

The extent of the framework region and CDRs has been precisely defined by a number of methods (see, Kabat, E. A., et al. (1991) Sequences of Proteins of Immunological Interest, Fifth Edition, U.S. Department of Health and Human Services, NIH Publication No. 91-3242; Chothia, C. et al. (1987) J. Mol. Biol. 196:901-917; and the AbM definition used by Oxford Molecular's AbM antibody modeling software. See, generally, e.g., Protein Sequence and Structure Analysis of Antibody Variable Domains. In: Antibody Engineering Lab Manual (Ed.: Duebel, S. and Kontermann, R., Springer-Verlag, Heidelberg). In an embodiment, the following definitions are used: AbM definition of CDR1 of the heavy chain variable domain and Kabat definitions for the other CDRs. In an embodiment, Kabat definitions are used for all CDRs. In addition, embodiments described with respect to Kabat or AbM CDRs may also be implemented using Chothia hypervariable loops. Each VH and VL typically includes three CDRs and four FRs, arranged from amino-terminus to carboxy-terminus in the following order: FR1, CDR1, FR2, CDR2, FR3, CDR3, and FR4.

As used herein, an "immunoglobulin variable domain sequence" refers to an amino acid sequence which can form the structure of an immunoglobulin variable domain. For example, the sequence may include all or part of the amino acid sequence of a naturally-occurring variable domain. For example, the sequence may or may not include one, two, or more N- or C-terminal amino acids or may include other alterations that are compatible with formation of the protein structure.

The term "antigen-binding region" refers to the part of an antibody molecule that comprises determinants that form an interface that binds to an antigen, or an epitope thereof. With respect to proteins (or protein mimetics), the antigen-binding region typically includes one or more loops (of at least, e.g., four amino acids or amino acid mimics) that form an interface that binds to the antigen. Typically, the antigen-binding region of an antibody molecule includes at least one or two CDRs and/or hypervariable loops, or more typically at least three, four, five or six CDRs and/or hypervariable loops.

The terms "compete" or "cross-compete" are used interchangeably herein to refer to the ability of an antibody molecule to interfere with binding of another antibody molecule to a target. The interference with binding can be direct or indirect (e.g., through an allosteric modulation of the antibody molecule or the target). The extent to which an antibody molecule is able to interfere with the binding of another antibody molecule to the target, and therefore whether it can be said to compete, can be determined using a competition binding assay, for example, a FACS assay, an ELISA or BIACORE assay. In an embodiment, a competition binding assay is a quantitative competition assay. In an embodiment, a first antibody molecule is said to compete for binding to the target with a second antibody molecule when the binding of the first antibody molecule to the target is reduced by 10% or more, e.g., 20% or more, 30% or more, 40% or more, 50% or more, 55% or more, 60% or more, 65% or more, 70% or more, 75% or more, 80% or more, 85% or more, 90% or more, 95% or more, 98% or more, 99% or more in a competition binding assay (e.g., a competition assay described herein).

The terms "monoclonal antibody" or "monoclonal antibody composition" as used herein refer to a preparation of antibody molecules of single molecular composition. A monoclonal antibody composition displays a single binding specificity and affinity for a particular epitope. A monoclonal antibody can be made by hybridoma technology or by methods that do not use hybridoma technology (e.g., recombinant methods).

An "effectively human" protein is a protein that does not evoke a neutralizing antibody response, e.g., the human anti-murine antibody (HAMA) response. HAMA can be problematic in a number of circumstances, e.g., if the antibody molecule is administered repeatedly, e.g., in treatment of a chronic or recurrent disease condition. A HAMA response can make repeated antibody administration potentially ineffective because of an increased antibody clearance from the serum (see, e.g., Saleh et al., Cancer Immunol. Immunother. 32:180-190 (1990)) and also because of potential allergic reactions (see, e.g., LoBuglio et al., Hybridoma, 5:5117-5123 (1986)).

The antibody molecule can be a polyclonal or a monoclonal antibody. In an embodiment, the antibody can be recombinantly produced, e.g., produced by any suitable phage display or combinatorial methods.

Various phage display and combinatorial methods for generating antibodies are known in the art (as described in, e.g., Ladner et al. U.S. Pat. No. 5,223,409; Kang et al. International Publication No. WO 92/18619; Dower et al. International Publication No. WO 91/17271; Winter et al. International Publication WO 92/20791; Markland et al. International Publication No. WO 92/15679; Breitling et al. International Publication WO 93/01288; McCafferty et al. International Publication No. WO 92/01047; Garrard et al. International Publication No. WO 92/09690; Ladner et al. International Publication No. WO 90/02809; Fuchs et al. (1991) Bio/Technology 9:1370-1372; Hay et al. (1992) Hum Antibod Hybridomas 3:81-85; Huse et al. (1989) Science 246:1275-1281; Griffths et al. (1993) EMBO J 12:725-734; Hawkins et al. (1992) J Mol Biol 226:889-896; Clackson et al. (1991) Nature 352:624-628; Gram et al. (1992) PNAS 89:3576-3580; Garrad et al. (1991) Bio/Technology 9:1373-1377; Hoogenboom et al. (1991) Nuc Acid Res 19:4133-4137; and Barbas et al. (1991) PNAS 88:7978-7982, the contents of all of which are incorporated by reference herein).

In an embodiment, the antibody molecule is a fully human antibody (e.g., an antibody made in a mouse which has been genetically engineered to produce an antibody from a human immunoglobulin sequence), or a non-human antibody, e.g., a rodent (mouse or rat), goat, primate (e.g., monkey), camel antibody. In an embodiment, the non-human antibody is a rodent (mouse or rat antibody). Methods of producing rodent antibodies are known in the art.

Human monoclonal antibodies can be generated using transgenic mice carrying the human immunoglobulin genes rather than the mouse system. Splenocytes from these transgenic mice immunized with the antigen of interest are used to produce hybridomas that secrete human mAbs with specific affinities for epitopes from a human protein (see e.g., Wood et al. International Application WO 91/00906, Kucherlapati et al. PCT publication WO 91/10741; Lonberg et al. International Application WO 92/03918; Kay et al. International Application 92/03917; Lonberg et al. 1994 Nature 368:856-859; Green, L. L. et al. 1994 Nature Genet. 7:13-21; Morrison, S. L. et al. 1994 Proc. Natl. Acad. Sci. USA 81:6851-6855; Bruggeman et al. 1993 Year Immunol 7:33-40; Tuaillon et al. 1993 PNAS 90:3720-3724; Bruggeman et al. 1991 Eur J Immunol 21:1323-1326).

An antibody can be one in which the variable region, or a portion thereof, e.g., the CDRs, are generated in a non-human organism, e.g., a rat or mouse. Chimeric, CDR-grafted, and humanized antibodies are within the invention. Antibodies generated in a non-human organism, e.g., a rat or mouse, and then modified, e.g., in the variable framework or constant region, to decrease antigenicity in a human are within the invention.

Chimeric antibodies can be produced by any suitable recombinant DNA technique. Several are known in the art (see Robinson et al., International Patent Publication PCT/US86/02269; Akira, et al., European Patent Application 184,187; Taniguchi, M., European Patent Application 171,496; Morrison et al., European Patent Application 173,494; Neuberger et al., International Application WO 86/01533; Cabilly et al. U.S. Pat. No. 4,816,567; Cabilly et al., European Patent Application 125,023; Better et al. (1988 Science 240:1041-1043); Liu et al. (1987) PNAS 84:3439-3443; Liu et al., 1987, J. Immunol. 139:3521-3526; Sun et al. (1987) PNAS 84:214-218; Nishimura et al., 1987, Canc. Res. 47:999-1005; Wood et al. (1985) Nature 314:446-449; and Shaw et al., 1988, J. Natl Cancer Inst. 80:1553-1559).

A humanized or CDR-grafted antibody will have at least one or two but generally all three recipient CDRs (of heavy and or light immunoglobulin chains) replaced with a donor CDR. The antibody may be replaced with at least a portion of a non-human CDR or only some of the CDRs may be replaced with non-human CDRs. It is only necessary to replace the number of CDRs required for binding of the humanized antibody to lipopolysaccharide. In an embodiment, the donor will be a rodent antibody, e.g., a rat or mouse antibody, and the recipient will be a human framework or a human consensus framework. Typically, the immunoglobulin providing the CDRs is called the "donor" and the immunoglobulin providing the framework is called the "acceptor." In an embodiment, the donor immunoglobulin is a non-human (e.g., rodent). The acceptor framework is typically a naturally-occurring (e.g., a human) framework or a consensus framework, or a sequence about 85% or higher, e.g., 90%, 95%, 99% or higher identical thereto.

As used herein, the term "consensus sequence" refers to the sequence formed from the most frequently occurring amino acids (or nucleotides) in a family of related sequences (See e.g., Winnaker, From Genes to Clones (Verlagsgesellschaft, Weinheim, Germany 1987). In a family of proteins, each position in the consensus sequence is occupied by the amino acid occurring most frequently at that position in the family. If two amino acids occur equally frequently, either can be included in the consensus sequence. A "consensus framework" refers to the framework region in the consensus immunoglobulin sequence.

An antibody can be humanized by any suitable method, and several such methods known in the art (see e.g., Morrison, S. L., 1985, *Science* 229:1202-1207, by Oi et al., 1986, *BioTechniques* 4:214, and by Queen et al. U.S. Pat. Nos. 5,585,089, 5,693,761 and 5,693,762, the contents of all of which are hereby incorporated by reference).

Humanized or CDR-grafted antibodies can be produced by CDR-grafting or CDR substitution, wherein one, two, or all CDRs of an immunoglobulin chain can be replaced. See e.g., U.S. Pat. No. 5,225,539; Jones et al. 1986 *Nature* 321:552-525; Verhoeyan et al. 1988 *Science* 239:1534; Beidler et al. 1988 *J. Immunol.* 141:4053-4060; Winter U.S. Pat. No. 5,225,539, the contents of all of which are hereby expressly incorporated by reference. Winter describes a CDR-grafting method which may be used to prepare humanized antibodies (UK Patent Application GB 2188638A, filed on Mar. 26, 1987; Winter U.S. Pat. No. 5,225,539), the contents of which is expressly incorporated by reference.

Also provided are humanized antibodies in which specific amino acids have been substituted, deleted or added. Criteria for selecting amino acids from the donor are described in, e.g., U.S. Pat. No. 5,585,089, e.g., columns 12-16 of U.S. Pat. No. 5,585,089, the contents of which are hereby incorporated by reference. Other techniques for humanizing antibodies are described in Padlan et al. EP 519596 A1, published on Dec. 23, 1992.

In an embodiment, the antibody molecule has a heavy chain constant region chosen from, e.g., the heavy chain constant regions of IgG1, IgG2 (e.g., IgG2a), IgG3, IgG4, IgM, IgA1, IgA2, IgD, and IgE; particularly, chosen from, e.g., the (e.g., human) heavy chain constant regions of IgG1, IgG2, IgG3, and IgG4. In another embodiment, the antibody molecule has a light chain constant region chosen from, e.g., the (e.g., human) light chain constant regions of kappa or lambda. The constant region can be altered, e.g., mutated, to modify the properties of the antibody molecule (e.g., to increase or decrease one or more of: Fc receptor binding, antibody glycosylation, the number of cysteine residues, effector cell function, and/or complement function). In an embodiment, the antibody molecule has effector function and can fix complement. In another embodiment, the antibody molecule does not recruit effector cells or fix complement. In certain embodiments, the antibody molecule has reduced or no ability to bind an Fc receptor. For example, it may be an isotype or subtype, fragment or other mutant, which does not support binding to an Fc receptor, e.g., it has a mutagenized or deleted Fc receptor binding region.

In an embodiment, a constant region of the antibody molecule is altered. Methods for altering an antibody constant region are known in the art. Antibody molecules s with altered function, e.g. altered affinity for an effector ligand, such as FcR on a cell, or the C1 component of complement can be produced by replacing at least one amino acid residue in the constant portion of the antibody with a different residue (see e.g., EP 388,151 A1, U.S. Pat. Nos. 5,624,821 and 5,648,260, the contents of all of which are hereby incorporated by reference) Amino acid mutations which stabilize antibody structure, such as S228P (EU nomenclature, S241P in Kabat nomenclature) in human IgG4 are also contemplated. Similar type of alterations could be described which if applied to the murine, or other species immunoglobulin would reduce or eliminate these functions.

In an embodiment, the only amino acids in the antibody molecule are canonical amino acids. In an embodiment, the antibody molecule comprises naturally-occurring amino acids; analogs, derivatives and congeners thereof; amino acid analogs having variant side chains; and/or all stereoisomers of any of any of the foregoing. The antibody molecule may comprise the D- or L-optical isomers of amino acids and peptidomimetics.

A polypeptide of an antibody molecule described herein may be linear or branched, it may comprise modified amino acids, and it may be interrupted by non-amino acids. The antibody molecule may also be modified; for example, by disulfide bond formation, glycosylation, lipidation, acetylation, phosphorylation, or any other manipulation, such as conjugation with a labeling component. The polypeptide can be isolated from natural sources, can be a produced by recombinant techniques from a eukaryotic or prokaryotic host, or can be a product of synthetic procedures.

The antibody molecule described herein can be used alone in unconjugated form, or can be bound to a substance, e.g., a toxin or moiety (e.g., a therapeutic drug; a compound emitting radiation; molecules of plant, fungal, or bacterial origin; or a biological protein (e.g., a protein toxin) or particle (e.g., a recombinant viral particle, e.g., via a viral coat protein). For example, the antibody molecule can be coupled to a radioactive isotope such as an $\alpha$-, $\beta$-, or $\gamma$-emitter, or a $\beta$- and $\gamma$-emitter.

An antibody molecule can be derivatized or linked to another functional molecule (e.g., another peptide or protein). As used herein, a "derivatized" antibody molecule is one that has been modified. Methods of derivatization include but are not limited to the addition of a fluorescent moiety, a radionucleotide, a toxin, an enzyme or an affinity ligand such as biotin. Accordingly, the antibody molecules are intended to include derivatized and otherwise modified forms of the antibodies described herein, including immunoadhesion molecules. For example, an antibody molecule can be functionally linked (by chemical coupling, genetic fusion, noncovalent association or otherwise) to one or more other molecular entities, such as another antibody (e.g., a bispecific antibody or a diabody), a detectable agent, a toxin, a pharmaceutical agent, and/or a protein or peptide that can mediate association of the antibody or antibody portion with another molecule (such as a streptavidin core region or a polyhistidine tag).

Some types of derivatized antibody molecule are produced by crosslinking two or more antibodies (of the same type or of different types, e.g., to create bispecific antibodies). Suitable crosslinkers include those that are heterobifunctional, having two distinctly reactive groups separated by an appropriate spacer (e.g., m-maleimidobenzoyl-N-hydroxysuccinimide ester) or homobifunctional (e.g., disuccinimidyl suberate). Such linkers are available from Pierce Chemical Company, Rockford, Ill.

Useful detectable agents with which an anti-dengue antibody molecule may be derivatized (or labeled) to include fluorescent compounds, various enzymes, prosthetic groups, luminescent materials, bioluminescent materials, fluorescent emitting metal atoms, e.g., europium (Eu), and other anthanides, and radioactive materials (described below). Exemplary fluorescent detectable agents include fluorescein, fluorescein isothiocyanate, rhodamine, 5dimethylamine-1-napthalenesulfonyl chloride, phycoerythrin and the like. An antibody may also be derivatized with detectable enzymes, such as alkaline phosphatase, horseradish peroxidase, $\beta$-galactosidase, acetylcholinesterase, glucose oxidase and the like. When an antibody is derivatized with a detectable enzyme, it is detected by adding additional reagents that the enzyme uses to produce a detectable reaction product. For example, when the detectable agent horseradish peroxidase is present, the addition of hydrogen peroxide and diaminobenzidine leads to a colored reaction product, which is detectable. An antibody molecule may also be derivatized with a prosthetic group (e.g., streptavidin/biotin and avidin/biotin). For example, an antibody may be derivatized with biotin, and detected through indirect measurement of avidin or streptavidin binding. Examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; and examples of bioluminescent materials include luciferase, luciferin, and aequorin.

Labeled antibody molecules can be used, for example, diagnostically and/or experimentally in a number of contexts, including (i) to isolate a predetermined antigen by standard techniques, such as affinity chromatography or immunoprecipitation; (ii) to detect a predetermined antigen (e.g., in a cellular lysate or cell supernatant) in order to evaluate the abundance and pattern of expression of the protein; (iii) to monitor protein levels in tissue as part of a clinical testing procedure, e.g., to determine the efficacy of a given treatment regimen.

An antibody molecule may be conjugated to another molecular entity, typically a label or a therapeutic (e.g., antimicrobial (e.g., antibacterial or bactericidal), immunomodulatory, immunostimularoty, cytotoxic, or cytostatic) agent or moiety. Radioactive isotopes can be used in diagnostic or therapeutic applications. Radioactive isotopes that can be coupled to the antibody molecules include, but are not limited to α-, β-, or γ-emitters, or β- and γ-emitters. Such radioactive isotopes include, but are not limited to iodine ($^{131}$I or $^{125}$I), yttrium ($^{90}$Y), lutetium ($^{177}$Lu), actinium ($^{225}$Ac), praseodymium, astatine ($^{211}$At), rhenium ($^{186}$Re), bismuth ($^{212}$Bi $^{213}$Bi), indium ($^{111}$In), technetium ($^{99}$mTc), phosphorus ($^{32}$P), rhodium ($^{188}$Rh), sulfur ($^{35}$S), carbon ($^{14}$C), tritium ($^{3}$H), chromium ($^{51}$Cr), chlorine ($^{36}$Cl), cobalt ($^{57}$Co or $^{58}$Co), iron ($^{59}$Fe), selenium ($^{75}$Se), or gallium ($^{67}$Ga). Radioisotopes useful as therapeutic agents include yttrium ($^{90}$Y), lutetium ($^{177}$Lu), actinium ($^{225}$Ac), praseodymium, astatine ($^{211}$At), rhenium ($^{186}$Re), bismuth ($^{212}$Bi or $^{213}$Bi), and rhodium ($^{188}$Rh). Radioisotopes useful as labels, e.g., for use in diagnostics, include iodine ($^{131}$I or $^{125}$I), indium ($^{111}$In), technetium ($^{99}$mTc), phosphorus ($^{32}$P), carbon ($^{14}$C), and tritium ($^{3}$H), or one or more of the therapeutic isotopes listed above.

In an aspect, this disclosure provides a method of making an IL-2 complex described herein. The method includes, e.g., contacting an IL-2 variant described herein with an anti-IL-2 antibody molecule (e.g., an anti-IL-2 antibody molecule that binds to the IL-2 variant), to thereby producing the IL-2 complex. In an embodiment, the method further comprises evaluating the efficacy of the IL-2 complex in vitro, ex vivo, or in vivo.

This disclosure provides an isolated nucleic acid molecule encoding an IL-2 complex (or a portion thereof) described herein, and vectors and host cells thereof. The nucleic acid molecule includes, but is not limited to, RNA, genomic DNA and cDNA.

IL-2 Conjugates

In an embodiment, the IL-2 agent comprises a conjugate, e.g., an IL-2 conjugate described herein.

In an embodiment, the IL-2 conjugate comprises an IL-2 variant described herein and a non-IL-2 moiety. In an embodiment, the IL-2 conjugate comprises one or more amino acid alterations (e.g., substitutions) described in Table 9. In an embodiment, the IL-2 conjugate comprises an amino acid sequence described in Table 9, or a functional fragment thereof. In an embodiment, the non-IL-2 moiety comprises an antibody molecule, e.g., an antibody molecule described herein. In an embodiment, the non-IL-2 moiety comprises a polymer, e.g., a polyether compound. In an embodiment, the polyether compound comprises polyethylene glycol (PEG). In an embodiment, the non-IL-2 moiety comprises a cytokine. The IL-2 variant can be coupled to the non-IL-2 moiety directly, or indirectly, e.g., through a linker. In an embodiment, the IL-2 conjugate is an IL-2 fusion protein.

In an embodiment, the IL-2 conjugate comprises an amino acid sequence chosen from: SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, SEQ ID NO: 1002, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

In an embodiment, the IL-2 conjugate is an immunoconjugate, e.g., comprising an antibody molecule. In an embodiment, the IL-2 variant is coupled to the antibody molecule by a covalent bond. In an embodiment, the IL-2 variant is coupled to the antibody molecule by a peptide bond. In an embodiment, the IL-2 variant and the antibody molecule forms a fusion protein. In an embodiment, the fusion protein comprises a linker between the IL-2 variant and the antibody molecule (e.g., a heavy chain, a light chain, or both). In an embodiment, the IL-2 variant is coupled to the antibody molecule by a non-peptide bond. In an embodiment, the IL-2 variant is not coupled to the antibody molecule by a non-peptide bond.

In an embodiment, the IL-2 variant is coupled to the backbone of the antibody molecule. In another embodiment, the IL-2 variant is coupled to a side chain of the antibody molecule. In an embodiment, the antibody molecule is coupled to the backbone of the IL-2 variant. In an embodiment, the antibody molecule is coupled to a side-chain of the IL-2 variant.

In an embodiment, two or more (e.g., three, four, five, six, seven, eight, or more) IL-2 variants are coupled to the antibody molecule. In an embodiment, four IL-2 variants are coupled to the antibody molecule. For example, the IL-2 variants can be the same, or at least some of the IL-2 variants are different from each other. In an embodiment, the IL-2 variant is coupled to the antibody molecule in a bivalent manner. In another embodiment, the IL-2 variant is coupled to the antibody molecule in a tetravalent manner.

In an embodiment, the IL-2 conjugate is produced by enzymatic synthesis. For example, IL-2 conjugates can be produced by chemical synthesis of an IL-2 variant, expression of an antibody molecule, and enzymatic ligation of the IL-2 variant to the antibody molecule. In an embodiment, 90% or more, e.g., 92% or more, 95% or more, 97% or more, or 99% or more, reaction efficiency is achieved. In another embodiment, the method further comprises purifying the ADC. In an embodiment, the yield is 60% or more (e.g., 70% or more, 75% or more, 80% or more, 90% or more, or 95% or more) after purification.

In an aspect, the disclosure provides a combination of (a) an immunoconjugate comprising a first antibody molecule having a reduced effector function and an IL-2 variant described herein, and (b) a second antibody molecule having an increased effector function, for use in treating a disorder, e.g., a disorder described herein.

In an embodiment, the reduced effector function of the first antibody comprises reduced binding to an activating Fc receptor, reduced ADCC, reduced ADCP, reduced CDC, reduced cytokine secretion, or a combination thereof. In an embodiment, the reduced effector function is reduced binding to an activating Fc receptor, e.g., a human Fc receptor. In an embodiment, the activating Fc receptor is an Fcy receptor. In an embodiment, the activating Fc receptor is FcγRIIIa, FcγRI, or FcγRIIa. In an embodiment, the reduced effector function comprises reduced ADCC. In an embodiment, the increased effector function comprises reduced binding to an activating Fc receptor and reduced ADCC.

In an embodiment, the first antibody molecule comprises one or more amino acid mutations (e.g., substitutions) in the Fc region as described herein. In an embodiment, the first antibody molecule comprises an amino acid substitution at position P329 of an immunoglobulin heavy chain. In an embodiment, the amino acid substitution comprises P329A or P329G, e.g., P329G. In an embodiment, the antibody molecule comprises a further amino acid substitution at a position of 5228, E233, L234, L235, N297, P331, or a combination thereof, of an immunoglobulin heavy chain. In an embodiment, the further amino acid substitution comprises S228P, E233P, L234A, L235A, L235E, N297A, N297D, P331S, or a combination thereof. In a particular embodiment the antibody comprises amino acid substitutions at positions P329, L234 and L235 of an immunoglobulin heavy chain. In an embodiment, the amino acid substitutions comprise L234A, L235A and P329G (LALA P329G).

In an embodiment, the first antibody molecule is directed to an antigen presented on a tumor cell or in a tumor cell environment. In an embodiment, the first antibody is directed to an antigen chosen from Fibroblast Activation Protein (FAP), the A1 domain of Tenascin-C (TNC A1), the A2 domain of Tenascin-C (TNC A2), the Extra Domain B of Fibronectin (EDB), Carcinoembryonic Antigen (CEA), and Melanoma-associated Chondroitin Sulfate Proteoglycan (MCSP).

In an embodiment the increased effector function of the second antibody molecule comprises increased binding to an activating Fc receptor, increased ADCC, increased ADCP, increased CDC, increased cytokine secretion, or a combination thereof. In an embodiment, the increased effector function comprises increased binding to an activating Fc receptor. In an embodiment, the activating Fc receptor is FcγRIIIa, FcγRI, or FcγRIIa. In an embodiment, the increased effector function comprises increased ADCC. In an embodiment, the increased effector function comprises increased binding to an activating Fc receptor and increased ADCC.

In an embodiment, the second antibody molecule comprises one or more amino acid mutations (e.g., substitutions) in the Fc region. In an embodiment, the second antibody molecule comprises a modification of the glycosylation in the Fc region. In an embodiment, the modification of the glycosylation in the Fc region comprises an increased proportion of non-fucosylated oligosaccharides in the Fc region (e.g., increased to at least 20%, 30%, 40%, 50%, 60%, 70%, 80%, or 90%) as compared to a non-modified antibody molecule. In an embodiment, the modification comprises an increased proportion of bisected oligosaccharides in the Fc region (e.g., increased to at least 20%, 30%, 40%, 50%, 60%, 70%, 80%, or 90%), as compared to a non-modified antibody molecule. In an embodiment, the modification of the glycosylation in the Fc region comprises an increased proportion of bisected, non-fucosylated oligosaccharides in the Fc region (e.g., increased to at least 20%, 30%, 40%, 50%, 60%, 70%, 80%, or 90%), as compared to a non-modified antibody molecule.

In an embodiment, the second antibody molecule is directed to an antigen presented on a tumor cell. In an embodiment, the second antibody molecule is directed to an antigen chosen from CD20, Epidermal Growth Factor Receptor (EGFR), HER2, HER3, Insulin-like Growth Factor 1 Receptor (IGF-1R), c-Met, CUB domain-containing protein-1 (CDCP1), Carcinoembryonic Antigen (CEA) and Melanoma-associated Chondroitin Sulfate Proteoglycan (MCSP).

In an embodiment, the disease is a disorder treatable by stimulation of effector cell function, e.g., a cancer. In an aspect, the disclosure provides a composition comprising: (a) an immunoconjugate comprising a first antibody molecule having a reduced effector function and an IL-2 variant described herein, (b) a second antibody molecule having an increased effector function, and (c) a pharmaceutically acceptable carrier.

IL-2 Receptors

The IL-2 agents (e.g., IL-2 variants, IL-2 fusion proteins, IL-2 complexes, or IL-2 conjugates) described herein can bind to an IL-2 receptor (IL-2R) and/or modulate one or more functions associated with an IL-2R.

IL-2R is a heterotrimeric protein expressed on the surface of certain immune cells, such as lymphocytes, that binds and responds to IL-2. IL-2 receptor typically has three forms, generated by different combinations of three different chains: α (alpha) (also known as IL-2Rα, CD25, or Tac antigen), β (beta) (also known as IL-2Rβ, or CD122), and γ (gamma) (also known as IL-2Rγ, γc, common gamma chain, or CD132).

The IL-2R chains are expressed separately and differently on various cell types and can assemble in different combinations and orders to generate low, intermediate, and high affinity IL-2Rs. IL-2Rα binds IL-2 with low affinity; IL-2Rβ and IL-2Rγ together form a complex that binds IL-2 with intermediate affinity (e.g., on memory T cells and NK cells); and IL-2Rα, IL-2R13, and IL-2Rγ together form a complex that binds IL-2 with high affinity (e.g., on activated T cells and regulatory T cells).

IL-2Rβ and IL-2Rγ complex with Janus kinase 1 (JAK1) and Janus kinase 3 (JAK3), respectively. The binding of IL-2 to IL-2R can activate JAK1/JAK2 and initiate downstream intracellular signaling, e.g., the MAP kinase pathway, the Phosphoinositide 3-kinase (PI3K) pathway, or the JAK-STAT pathway (Liao et al., *Curr Opin Immunol.* 2011; 23(5): 598-604; Malek and Castro. *Immunity.* 2010; 33(2): 153-165).

IL-2R plays important roles in the immune system, tolerance and immunity. For example, the interaction between IL-2 and IL-2R is involved in promoting the differentiation of certain immature T cells into regulatory T cells, and the differentiation of T cells into effector T cells and into memory T cells. The interaction between IL-2 and IL-2R is also associated with autoimmune diseases, infections, and cell-mediated immunity.

In an aspect, the disclosure provides IL-2 agents comprising an IL-2 variant described herein that has an altered binding affinity to an IL-2R, e.g., one, two, or all of IL-2Rα, IL-2R13, or IL-2Rγ. For example, the IL-2 variant can have one or more (e.g., two, three, four, five, or more) amino acid alternations (e.g., substitutions or mutations) associated with the interaction between IL-2 and IL-2R, e.g., one, two, or all of IL-2Rα, IL-2Rβ, or IL-2Rγ.

In an embodiment, the IL-2 agent has an altered (e.g., reduced) binding affinity to IL-2Rα. In an embodiment, the binding affinity to IL-2Rα is reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant. In an embodiment, the IL-2 agent has an altered (e.g., reduced) binding affinity to IL-2Rβ. In an embodiment, the binding affinity to IL-2Rβ is reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant. In an embodiment, the IL-2 agent has an altered (e.g., reduced) binding affinity to IL-2Rγ. In an embodiment, the binding affinity to IL-2Rγ is reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant.

In an embodiment, the IL-2 agent has an altered (e.g., reduced) binding affinity to IL-2Rα and an altered (e.g., reduced) binding affinity to IL-2Rβ. In an embodiment, the binding affinity to IL-2Rα is reduced by about 10%, 20%, 30%, 40%, 50%, 60%, 70%, 80%, 90%, or more, and the binding affinity to IL-2Rβ is reduced by about 10%, 20%, 30%, 40%, 50%, 60%, 70%, 80%, 90%, or more. In an embodiment, the binding affinities to IL-2Rα and IL-2Rβ are reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant.

In an embodiment, the IL-2 agent has an altered (e.g., reduced) binding affinity to IL-2Rα and an altered (e.g., reduced) binding affinity to IL-2Rγ. In an embodiment, the binding affinity to IL-2Rα is reduced by about 10%, 20%, 30%, 40%, 50%, 60%, 70%, 80%, 90%, or more, and the binding affinity to IL-2Rγ is reduced by about 10%, 20%, 30%, 40%, 50%, 60%, 70%, 80%, 90%, or more. In an embodiment, the binding affinities to IL-2Rα and IL-2Rγ are reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant.

In an embodiment, the IL-2 agent has an altered (e.g., reduced) binding affinity to IL-2Rβ and an altered (e.g., reduced) binding affinity to IL-2Rγ. In an embodiment, the binding affinity to IL-2Rβ is reduced by about 10%, 20%, 30%, 40%, 50%, 60%, 70%, 80%, 90%, or more, and the binding affinity to IL-2Rγ is reduced by about 10%, 20%, 30%, 40%, 50%, 60%, 70%, 80%, 90%, or more. In an embodiment, the binding affinities to IL-2Rβ and IL-2Rγ are reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant.

In an embodiment, the IL-2 agent has an altered (e.g., reduced) binding affinity to IL-2Rα, an altered (e.g., reduced) binding affinity to IL-2Rβ, and an altered (e.g., reduced) binding affinity to IL-2Rγ. In an embodiment, the binding affinity to IL-2Rα is reduced by about 10%, 20%, 30%, 40%, 50%, 60%, 70%, 80%, 90%, or more, the binding affinity to IL-2Rβ is reduced by about 10%, 20%, 30%, 40%, 50%, 60%, 70%, 80%, 90%, or more, and the binding affinity to IL-2Rγ is reduced by about 10%, 20%, 30%, 40%, 50%, 60%, 70%, 80%, 90%, or more. In an embodiment, the binding affinities to IL-2Rα, IL-2Rβ, and IL-2Rγ are reduced by about 10%, 20%, 30%, 40%, 50%, 60%, 70%, 80%, 90%, or more, relative to an IL-2 agent comprising a wild-type IL-2 or an IL-2 agent comprising a reference IL-2 variant.

In an embodiment, the binding affinity of an IL-2 agent provided by the disclosure to any of IL-2Rα, IL-2Rβ, or IL-2Rγ is reduced, but not abolished. For example, the reduction can range from about 10% to about 90%, e.g., from about 20% to about 80%, from about 30% to about 70%, from about 40% to about 60%, from about 10% to about 50%, or from about 50% to about 90%, relative to an IL-2 agent comprising a wild-type IL-2 or an IL-2 agent comprising a reference IL-2 variant.

Fc Region

The present disclosure provides IL-2 agents (e.g., IL-2 variants, fusion polypeptides, complexes, or immunoconjugates) comprising an Fc region or a fragment thereof, e.g., an Fc region, or a fragment thereof (e.g., a functional fragment thereof), described herein.

In an embodiment, the IL-2 agent comprises an IL-2 variant described herein and an Fc region described herein. In an embodiment, the IL-2 agent further comprises a linker between the IL-2 variant and the Fc region. In an embodiment, the IL-2 agent comprises an IL-2 fusion protein comprising an Fc region described herein. In an embodiment, the Fc region comprises one or more mutations described herein.

A fragment crystallizable region, or Fc region, refers to a region of an immunoglobulin that interacts with an Fc receptor. In an embodiment, the Fc region interacts with a protein of the complement system. While without wishing to be bound by theory, it is believed that in an embodiment, the interaction between the Fc region with an Fc receptor, allows for activation of the immune system.

In IgG, IgA and IgD antibody isotypes, the naturally-occurring Fc region generally comprises two identical protein fragments, derived from the second and third constant domains of the antibody's two heavy chains. Naturally-occurring IgM and IgE Fc regions generally comprise three heavy chain constant domains ($C_H$ domains 2-4) in each polypeptide chain. The Fc regions of IgGs can contain a highly conserved N-glycosylation site (Stadlmann et al. (2008). *Proteomics* 8 (14): 2858-2871; Stadlmann (2009) *Proteomics* 9 (17): 4143-4153). While not wishing to be bound by theory, it is believed that in an embodiment, glycosylation of the Fc fragment contributes to Fc receptor-mediated activities (Peipp et al. (2008) *Blood* 112 (6): 2390-2399). In an embodiment, the N-glycans attached to this site are predominantly core-fucosylated diantennary structures of the complex type. In another embodiment, small amounts of these N-glycans also contain bisecting GlcNAc and/or α-2,6 linked sialic acid residues.

An exemplary fragment of an Fc region amino acid sequence from human IgG1 is provided in SEQ ID NO: 40 and is shown below:

(SEQ ID NO: 40)
DKTHTCPPCPAPELLGGPSVFLFPPKPKDTLMISRTPEVTCVVVDVS

HEDPEVKFNWYVDGVEVHNAKTKPREEQYGSTYRVVSVLTVL<u>H</u>QDWL

NGKEYKCKVSNKALPAPIEKTISKAKGQPREPQVYTLPPSRDELTKN

QVSLTCLVKGFYPSDIAVEWESNGQPENNYKTTPPVLDSDGSFFLYS

KLTVDKSRWQQGNVFSCSVMHEAL<u>HNH</u>YTQKSLSLSPGK

In SEQ ID NO: 40, the first amino acid residue in this sequence is referred to as position 221 herein. The three histidine residues shown in bold and underlined are positions 310, 433 and 435, respectively.

An IL-2 agent comprising an Fc region or fragment thereof (e.g., IL-2-Fc fusion protein) described herein can have one or more (e.g., 2, 3, 4, 5, 6, 7, 8, 9, 10, 11, 12, 13, 14, 15, 16, 17, 18, 19, 20, 21, 22, 23, 24, 25, or more) of mutations or combinations of mutations described in Table 1 (e.g., according to EU numbering).

TABLE 1

| Name | Mutation |
| --- | --- |
| FcMut001 | I253M |
| FcMut002 | L309H_D312A_N315D |
| FcMut003 | L309N |
| FcMut004 | M252E_S254R |
| FcMut005 | M252E_S254R_R255Y |
| FcMut006 | S254H |
| FcMut007 | S254M |
| FcMut008 | T256D_T307R |
| FcMut009 | T256L_N286I_T307I |
| FcMut010 | T256I_N286I_T307I |
| FcMut011 | K248S_D376Q |
| FcMut012 | K248S_D376N |
| FcMut013 | D376Q_E380A |
| FcMut014 | D376N_E380A |
| FcMut015 | D376Q_M428L |
| FcMut016 | K248S_A378I |
| FcMut017 | L314K |
| FcMut018 | T250Q_M428L |
| FcMut019 | M428L_N434A |
| FcMut020 | N434A |
| FcMut021 | T307A_E380A_N434A |
| FcMut022 | M252W |
| FcMut023 | V308F |
| FcMut024 | V308F_N434Y |
| FcMut026 | T256D_T307R_D376N |
| FcMut027 | L309R_D312E |
| FcMut028 | L309R_Q311P_D312E |
| FcMut029 | K246N_P247A |
| FcMut030 | K246N_P247A_D376N |
| FcMut031 | T256E_T307R |
| FcMut032 | T256R_T307D |
| FcMut033 | T256R_T307E |
| FcMut034 | Q311P |
| FcMut035 | D376Q |
| FcMut036 | L234A_L235A |
| FcMut037 | L235V_G236A |
| FcMut038 | L234P_L235P |
| FcMut039 | L235P |
| FcMut040 | P329G |
| FcMut041 | P329E |
| FcMut042 | E233K |
| FcMut043 | T256D_N286D_A287S_T307R |
| FcMut044 | T256D_P257L_T307R |
| FcMut045 | T256D_T307R_Q311V |
| FcMut046 | P247D_T256D_T307R |
| FcMut047 | P247D_N286D_A287S_Q311V |
| FcMut048 | P257M_V308N |
| FcMut049 | V279I_Q311L_N315T |
| FcMut050 | M428L_N434S |
| FcMut051 | N434S |
| FcMut052 | H433G_N434P |
| FcMut053 | V259I_V308F_M428L |
| FcMut067 | T256D_N286D_T307R |
| FcMut068 | T256D_N286E_T307R |
| FcMut069 | T256D_N286Q_T307R |
| FcMut070 | T256D_P257T_T307R |
| FcMut071 | T256D_P257V_T307R |
| FcMut072 | T256D_T307R_Q311I |
| FcMut073 | T256D_T307R_Q311L |
| FcMut074 | T256D_T307R_Q311M |
| FcMut075 | T256D_P257L_N286D_T307R_Q311V |
| FcMut076 | T256D_T307R_M428L |
| FcMut077 | M428L |
| FcMut078 | M252Y_S254T_T256Q |
| FcMut079 | M252Y_S254T_T256E_K288E |
| FcMut080 | T256K_K288E |
| FcMut081 | T256D_E258T |
| FcMut082 | E283Q_H285E |
| FcMut083 | R344D_D401R |
| FcMut084 | K248E_E380K |
| FcMut085 | K248E_E380R |
| FcMut086 | K246H |
| FcMut087 | K248H |
| FcMut088 | T250I |
| FcMut089 | T250V |
| FcMut090 | L251F |
| FcMut091 | L251M |
| FcMut093 | P257V |
| FcMut094 | N276D |
| FcMut095 | H285N |
| FcMut096 | H285D |
| FcMut097 | K288H |
| FcMut098 | K288Q |
| FcMut099 | K288E |
| FcMut100 | T307E |
| FcMut101 | T307Q |
| FcMut102 | V308P |
| FcMut103 | V308I |
| FcMut104 | V308L |
| FcMut105 | L309H |
| FcMut106 | L309M |
| FcMut107 | Q311H |
| FcMut108 | L314F |
| FcMut109 | Y319H |
| FcMut110 | I336T |
| FcMut111 | P343D |
| FcMut112 | P343V |
| FcMut113 | E345Q |
| FcMut114 | P346V |
| FcMut115 | P374T |
| FcMut116 | D376N |
| FcMut117 | A378S |
| FcMut118 | A431T |
| FcMut119 | A431P |
| FcMut120 | A431G |
| FcMut121 | L432V |
| FcMut122 | L432I |
| FcMut123 | L432Q |
| FcMut124 | N434T |
| FcMut125 | H435N |
| FcMut126 | Y436H |
| FcMut127 | K439Q |
| FcMut128 | T256D |
| FcMut129 | T307R |
| FcMut130 | A378T |
| FcMut131 | A378D |
| FcMut132 | A378H |
| FcMut133 | A378Y |
| FcMut134 | A378V |
| FcMut135 | D376R |
| FcMut136 | D376F |
| FcMut137 | D376W |
| FcMut138 | L314H |
| FcMut139 | L432E_T437Q |
| FcMut140 | D376Q_A378T |
| FcMut141 | D376Q_I377M_A378T |
| FcMut142 | P244Q_D376Q |
| FcMut143 | P247T_A378T |
| FcMut144 | P247N_A378T |
| FcMut145 | T256D_T307R_L309T |
| FcMut146 | A339T_S375E_F404Y |
| FcMut147 | L235V_G236A_T256D_T307R |
| FcMut148 | L235V_G236A_D376Q_M428L |
| FcMut149 | L314N |
| FcMut150 | N315D |
| FcMut151 | A378T |
| FcMut152 | T437Q |
| FcMut153 | L432E |

TABLE 1-continued

Exemplary Fc mutations

| Name | Mutation |
|------|----------|
| FcMut154 | Y436R |
| FcMut155 | L314M |
| FcMut156 | L234A_L235A_T256D_T307R_Q311V |
| FcMut157 | L234A_L235A_T256D_P257V_T307R |
| FcMut158 | L234A_L235A_T256D_P257L_N286D_T307R_Q311V |
| FcMut159 | L235V_G236A_T256D_T307R_Q311V |
| FcMut160 | L235V_G236A_T256D_P257V_T307R |
| FcMut161 | L235V_G236A_T256D_P257L_N286D_T307R_Q311V |
| FcMut162 | S267T_A327N_A330M |
| FcMut163 | S267T_A327N |
| FcMut164 | L235V_G236A_S267T_A327N_A330M |
| FcMut165 | L235V_G236A_S267T_A327N |
| FcMut166 | M252Y_S254T |
| FcMut167 | T256E |
| FcMut168 | G236A_I332E |
| FcMut169 | S239D_I332E |
| FcMut170 | G236A_S239D_I332E |
| FcMut171 | T256D_N286D_T307R_Q311V |
| FcMut172 | T256D_E258T_T307R |
| FcMut173 | T256D_E258T_T307R_Q311V |
| FcMut174 | T256D_P257V_E258T_T307R |
| FcMut175 | T256D_P257L_E258T_N286D_T307R_Q311V |
| FcMut176 | T256D_E258T_N286D_T307R_Q311V |
| FcMut177 | A378V_M428L |
| FcMut178 | A378V_M428I |
| FcMut179 | A378V_M428V |
| FcMut180 | T256D_N286D |
| FcMut181 | T256D_A378V |
| FcMut182 | T256D_Q311V |
| FcMut183 | T256D_Q311V_A378V |
| FcMut184 | T256D_T307R_A378V |
| FcMut185 | T256D_N286D_T307R_A378V |
| FcMut186 | T256D_T307R_Q311V_A378V |
| FcMut187 | H285D_A378V |
| FcMut188 | H285D_Q311V |
| FcMut189 | T256D_H285D |
| FcMut190 | T256D_H285D_Q311V |
| FcMut191 | T256D_H285D_T307R |
| FcMut192 | T256D_H285D_T307R_A378V |
| FcMut193 | H285D_L314M_A378V |
| FcMut194 | T256D_E258T_H285D_Q311H |
| FcMut195 | T256D_E258T_H285D |
| FcMut196 | H285D_N315D |
| FcMut197 | H285N_T307Q_N315D |
| FcMut198 | H285D_L432E_T437Q |
| FcMut199 | T256D_E258T_N315D |
| FcMut200 | P257V_H285N |
| FcMut201 | H285N_L432F |
| FcMut202 | H285N_T437I |
| FcMut203 | T256D_E258T_L314M |
| FcMut204 | T256D_E258T_T307Q |
| FcMut205 | T256D_E258T_A378V |
| FcMut206 | V308P_A378V |
| FcMut207 | P257V_A378T |
| FcMut208 | P257V_V308P_A378V |
| FcMut209 | N315D_A378T |
| FcMut210 | H285N_L314M |
| FcMut211 | L314M_L432E_T437Q |
| FcMut212 | T307Q_N315D |
| FcMut213 | H285D_T307Q_A378V |
| FcMut214 | L314M_N315D |
| FcMut215 | T307Q_Q311V_A378V |
| FcMut216 | H285D_Q311V_A378V |
| FcMut217 | Q311V_N315D_A378V |
| FcMut218 | T256D_E258T_Q311V |
| FcMut219 | T256D_N315D_A378V |
| FcMut220 | T256D_Q311V_N315D |
| FcMut221 | T256D_T307Q_A378V |
| FcMut222 | T256D_T307Q_Q311V |
| FcMut223 | T256D_H285D_A378V |
| FcMut224 | T256D_H285D_T307R_Q311V |
| FcMut225 | T256D_H285D_N286D_T307R |
| FcMut226 | T256D_H285D_N286D_T307R_Q311V |
| FcMut227 | T256D_H285D_N286D_T307R_A378V |
| FcMut228 | T256D_N286D_T307R_Q311V_A378V |
| FcMut229 | T256D_H285D_T307R_Q311V_A378V |
| FcMut230 | V308P_Q311V_A378V |
| FcMut231 | T256D_V308P_A378V |
| FcMut232 | T256D_V308P_Q311V |
| FcMut233 | T256D_E258T_V308P |
| FcMut234 | H285D_V308P_Q311V |
| FcMut242 | E258T |
| FcMut243 | N286D |
| FcMut244 | Q311V |
| YTE | M252Y_S254T_T256E |

In an embodiment, the Fc region comprises FcMut001. In an embodiment, the Fc region comprises FcMut002. In an embodiment, the Fc region comprises FcMut003. In an embodiment, the Fc region comprises FcMut004. In an embodiment, the Fc region comprises FcMut005. In an embodiment, the Fc region comprises FcMut006. In an embodiment, the Fc region comprises FcMut007. In an embodiment, the Fc region comprises FcMut008. In an embodiment, the Fc region comprises FcMut009. In an embodiment, the Fc region comprises FcMut010. In an embodiment, the Fc region comprises FcMut011. In an embodiment, the Fc region comprises FcMut012. In an embodiment, the Fc region comprises FcMut013. In an embodiment, the Fc region comprises FcMut014. In an embodiment, the Fc region comprises FcMut015. In an embodiment, the Fc region comprises FcMut016. In an embodiment, the Fc region comprises FcMut017. In an embodiment, the Fc region comprises FcMut018. In an embodiment, the Fc region comprises FcMut019. In an embodiment, the Fc region comprises FcMut020. In an embodiment, the Fc region comprises FcMut021. In an embodiment, the Fc region comprises FcMut022. In an embodiment, the Fc region comprises FcMut023. In an embodiment, the Fc region comprises FcMut024. In an embodiment, the Fc region comprises FcMut026. In an embodiment, the Fc region comprises FcMut027. In an embodiment, the Fc region comprises FcMut028. In an embodiment, the Fc region comprises FcMut029. In an embodiment, the Fc region comprises FcMut030. In an embodiment, the Fc region comprises FcMut031. In an embodiment, the Fc region comprises FcMut032. In an embodiment, the Fc region comprises FcMut033. In an embodiment, the Fc region comprises FcMut034. In an embodiment, the Fc region comprises FcMut035. In an embodiment, the Fc region comprises FcMut036. In an embodiment, the Fc region comprises FcMut037. In an embodiment, the Fc region comprises FcMut038. In an embodiment, the Fc region comprises FcMut039. In an embodiment, the Fc region comprises FcMut040. In an embodiment, the Fc region comprises FcMut041. In an embodiment, the Fc region comprises FcMut042. In an embodiment, the Fc region comprises FcMut043. In an embodiment, the Fc region comprises FcMut044. In an embodiment, the Fc region comprises FcMut045. In an embodiment, the Fc region comprises FcMut046. In an embodiment, the Fc region comprises FcMut047. In an embodiment, the Fc region comprises FcMut048. In an embodiment, the Fc region comprises FcMut049. In an embodiment, the Fc region comprises FcMut050. In an embodiment, the Fc region comprises FcMut051. In an embodiment, the Fc region comprises FcMut052. In an embodiment, the Fc region comprises FcMut053. In an embodiment, the Fc region comprises FcMut067. In an embodiment, the Fc region comprises FcMut068. In an embodiment, the Fc region comprises FcMut069. In an embodiment, the Fc region comprises FcMut070. In an embodiment, the Fc region comprises FcMut071. In an embodiment, the Fc region comprises FcMut072. In an embodiment, the Fc region comprises FcMut073. In an embodiment, the Fc region comprises FcMut074. In an embodiment, the Fc region comprises FcMut075. In an embodiment, the Fc region comprises FcMut076. In an embodiment, the Fc region comprises FcMut077. In an embodiment, the Fc region comprises FcMut078. In an embodiment, the Fc region comprises FcMut079. In an embodiment, the Fc region comprises FcMut080. In an embodiment, the Fc region comprises FcMut081. In an embodiment, the Fc region comprises FcMut082. In an embodiment, the Fc region comprises FcMut083. In an embodiment, the Fc region comprises FcMut084. In an embodiment, the Fc region comprises FcMut085. In an embodiment, the Fc region comprises FcMut086. In an embodiment, the Fc region comprises FcMut087. In an embodiment, the Fc region comprises FcMut088. In an embodiment, the Fc region comprises FcMut089. In an embodiment, the Fc region comprises FcMut090. In an embodiment, the Fc region comprises FcMut091. In an embodiment, the Fc region comprises FcMut093. In an embodiment, the Fc region comprises FcMut094. In an embodiment, the Fc region comprises FcMut095. In an embodiment, the Fc region comprises FcMut096. In an embodiment, the Fc region comprises FcMut097. In an embodiment, the Fc region comprises FcMut098. In an embodiment, the Fc region comprises FcMut099. In an embodiment, the Fc region comprises FcMut100. In an embodiment, the Fc region comprises FcMut101. In an embodiment, the Fc region comprises FcMut102. In an embodiment, the Fc region comprises FcMut103. In an embodiment, the Fc region comprises FcMut104. In an embodiment, the Fc region comprises FcMut105. In an embodiment, the Fc region comprises FcMut106. In an embodiment, the Fc region comprises FcMut107. In an embodiment, the Fc region comprises FcMut108. In an embodiment, the Fc region comprises FcMut109. In an embodiment, the Fc region comprises FcMut110. In an embodiment, the Fc region comprises FcMut111. In an embodiment, the Fc region comprises FcMut112. In an embodiment, the Fc region comprises FcMut113. In an embodiment, the Fc region comprises FcMut114. In an embodiment, the Fc region comprises FcMut115. In an embodiment, the Fc region comprises FcMut116. In an embodiment, the Fc region comprises FcMut117. In an embodiment, the Fc region comprises FcMut118. In an embodiment, the Fc region comprises FcMut119. In an embodiment, the Fc region comprises FcMut120. In an embodiment, the Fc region comprises FcMut121. In an embodiment, the Fc region comprises FcMut122. In an embodiment, the Fc region comprises FcMut123. In an embodiment, the Fc region comprises FcMut124. In an embodiment, the Fc region comprises FcMut125. In an embodiment, the Fc region comprises FcMut126. In an embodiment, the Fc region comprises FcMut127. In an embodiment, the Fc region comprises FcMut128. In an embodiment, the Fc region comprises FcMut129. In an embodiment, the Fc region comprises FcMut130. In an embodiment, the Fc region comprises FcMut131. In an embodiment, the Fc region comprises FcMut132. In an embodiment, the Fc region comprises FcMut133. In an embodiment, the Fc region comprises FcMut134. In an embodiment, the Fc region comprises FcMut135. In an embodiment, the Fc region comprises FcMut136. In an embodiment, the Fc region comprises FcMut137. In an embodiment, the Fc region comprises FcMut138. In an embodiment, the Fc region comprises FcMut139. In an embodiment, the Fc region comprises FcMut140. In an embodiment, the Fc region comprises FcMut141. In an embodiment, the Fc region comprises FcMut142. In an embodiment, the Fc region comprises FcMut143. In an embodiment, the Fc region comprises FcMut144. In an embodiment, the Fc region comprises FcMut145. In an embodiment, the Fc region comprises FcMut146. In an embodiment, the Fc region comprises FcMut147. In an embodiment, the Fc region comprises FcMut148. In an embodiment, the Fc region comprises FcMut149. In an embodiment, the Fc region comprises FcMut150. In an embodiment, the Fc region comprises FcMut151. In an embodiment, the Fc region comprises FcMut152. In an embodiment, the Fc region comprises FcMut153. In an embodiment, the Fc region comprises FcMut154. In an embodiment, the Fc region comprises FcMut155. In an embodiment, the Fc region comprises FcMut156. In an embodiment, the Fc region comprises FcMut157. In an embodiment, the Fc region comprises FcMut158. In an embodiment, the Fc region comprises FcMut159. In an embodiment, the Fc region comprises FcMut160. In an embodiment, the Fc region comprises FcMut161. In an embodiment, the Fc region comprises FcMut162. In an embodiment, the Fc region comprises FcMut163. In an embodiment, the Fc region comprises FcMut164. In an embodiment, the Fc region comprises FcMut165. In an embodiment, the Fc region comprises FcMut166. In an embodiment, the Fc region comprises FcMut167. In an embodiment, the Fc region comprises FcMut168. In an embodiment, the Fc region comprises FcMut169. In an embodiment, the Fc region comprises FcMut170. In an embodiment, the Fc region comprises FcMut171. In an embodiment, the Fc region comprises FcMut172. In an embodiment, the Fc region comprises FcMut173. In an embodiment, the Fc region comprises FcMut174. In an embodiment, the Fc region comprises FcMut175. In an embodiment, the Fc region comprises FcMut176. In an embodiment, the Fc region comprises FcMut177. In an embodiment, the Fc region comprises FcMut178. In an embodiment, the Fc region comprises FcMut179. In an embodiment, the Fc region comprises FcMut180. In an embodiment, the Fc region comprises FcMut181. In an embodiment, the Fc region comprises FcMut182. In an embodiment, the Fc region comprises FcMut183. In an embodiment, the Fc region comprises FcMut184. In an embodiment, the Fc region comprises FcMut185. In an embodiment, the Fc region comprises FcMut186. In an embodiment, the Fc region comprises FcMut187. In an embodiment, the Fc region comprises FcMut188. In an embodiment, the Fc region comprises FcMut189. In an embodiment, the Fc region comprises FcMut190. In an embodiment, the Fc region comprises FcMut191. In an embodiment, the Fc region comprises FcMut192. In an embodiment, the Fc region comprises FcMut193. In an embodiment, the Fc region comprises FcMut194. In an embodiment, the Fc region comprises FcMut195. In an embodiment, the Fc region comprises FcMut196. In an embodiment, the Fc region comprises FcMut197. In an embodiment, the Fc region comprises FcMut198. In an embodiment, the Fc region comprises FcMut199. In an embodiment, the Fc region comprises FcMut200. In an embodiment, the Fc region comprises FcMut201. In an embodiment, the Fc region comprises FcMut202. In an embodiment, the Fc region comprises FcMut203. In an embodiment, the Fc region comprises FcMut204. In an embodiment, the Fc region comprises FcMut205. In an embodiment, the Fc region comprises FcMut206. In an embodiment, the Fc region comprises FcMut207. In an embodiment, the Fc region comprises FcMut208. In an embodiment, the Fc region comprises FcMut209. In an embodiment, the Fc region comprises FcMut210. In an embodiment, the Fc region comprises FcMut211. In an embodiment, the Fc region comprises FcMut212. In an embodiment, the Fc region comprises FcMut213. In an embodiment, the Fc region comprises FcMut214. In an embodiment, the Fc region comprises FcMut215. In an embodiment, the Fc region comprises FcMut216. In an embodiment, the Fc region comprises FcMut217. In an embodiment, the Fc region comprises FcMut218. In an embodiment, the Fc region comprises FcMut219. In an embodiment, the Fc region comprises FcMut220. In an embodiment, the Fc region comprises FcMut221. In an embodiment, the Fc region comprises FcMut222. In an embodiment, the Fc region comprises FcMut223. In an embodiment, the Fc region comprises FcMut224. In an embodiment, the Fc region comprises FcMut225. In an embodiment, the Fc region comprises FcMut226. In an embodiment, the Fc region comprises FcMut227. In an embodiment, the Fc region comprises FcMut228. In an embodiment, the Fc region comprises FcMut229. In an embodiment, the Fc region comprises FcMut230. In an embodiment, the Fc region comprises FcMut231. In an embodiment, the Fc region comprises FcMut232. In an embodiment, the Fc region comprises FcMut233. In an embodiment, the Fc region comprises FcMut234. In an embodiment, the Fc region comprises FcMut242. In an embodiment, the Fc region comprises FcMut243. In an embodiment, the Fc region comprises FcMut244.

In an embodiment, the Fc region comprises one or more (e.g., 2, 3, 4, 5, 6, 7, 8, 9, or more) of mutations or combinations of mutations chosen from FcMut045, FcMut171, FcMut183, FcMut186, FcMut190, FcMut197, FcMut213, FcMut215, FcMut216, FcMut219, FcMut222, FcMut223, FcMut224, FcMut226, FcMut227, FcMut228, or FcMut229. In an embodiment, the Fc region comprises one or more (e.g., 2, 3, 4, 5, 6, or all) of mutations or combinations of mutations chosen from FcMut045, FcMut183, FcMut197, FcMut213, FcMut215, FcMut228, or FcMut156. In another embodiment, the Fc region comprises one or more (e.g., 2, 3, 4, 5, or all) of mutations or combinations of mutations chosen from FcMut183, FcMut197, FcMut213, FcMut215, FcMut228, or FcMut229.

In an embodiment, the Fc region does not comprise one or more (e.g., 2, 3, 4, or all) of mutations or combinations of mutations chosen from FcMut018, FcMut021, FcMut050, FcMut102, or YTE. In an embodiment, the Fc region comprises one or more (e.g., 2, 3, 4, or all) of mutations or combinations of mutations chosen from FcMut018, FcMut021, FcMut050, FcMut102, or YTE, and one or more other mutations or combinations of mutations described in Table 1.

In an embodiment, the Fc region comprises one or more (e.g., 2, 3, 4, 5, 6, 7, 8, 9, 10, 11, 12, 13, 14, 15, 16, 17, 18, 19, 20, or more) of mutations or combinations of mutations described in Table 1 that result in a synergistic effect (e.g., binding affinity or circulating half-life) as described herein.

In an embodiment, the Fc region comprises one or more (e.g., 2, 3, 4, 5, 6, or 7) mutations in residues chosen from T256, H285, N286, T307, Q311, N315, or A378. In an embodiment, the Fc region comprises one or more (e.g., 2, 3, 4, 5, 6, or 7) mutations chosen from T256D, H285N, N286D, T307Q, Q311V, N315D, or A378V.

In an embodiment, the Fc region comprises a half-life enhancing mutation, a mutation that is capable of disrupting an Fc effector function, or both. In an embodiment, the Fc region comprises one or more mutations or combinations of mutations described herein, e.g., chosen from M252W, V308F/N434Y, R255Y, P257L/N434Y, V308F, P257N/M252Y, G385N, P257N/V308Y, N434Y, M252Y/S254T/T256E ("YTE"), M428L/N434S ("LS"), or any combination thereof. Alternatively, or additionally, in an embodiment, the Fc region comprises (a) one or more (e.g., 2, 3, 4, 5, or all) combinations of mutations chosen from: T256D/Q311V/A378V, H285N/T307Q/N315D, H285D/T307Q/A378V, T307Q/Q311V/A378V, T256D/N286D/T307R/Q311V/A378V, or T256D/T307R/Q311V; (b) a mutation or a combination of mutations capable of disrupting an Fc effector function, e.g., N297G, L234A/L235A (also known as "LALA" mutation), L234A/L235A/P329G (also known as "LALAPG" mutation), or (c) both (a) and (b).

In an embodiment, the Fc region comprises mutations T256D/Q311V/A378V and a mutation or a combination of mutations capable of disrupting an Fc effector function, e.g., L234A/L235A. In an embodiment, the Fc region comprises mutations H285N/T307Q/N315D and a mutation or a combination of mutations capable of disrupting an Fc effector function, e.g., L234A/L235A. In an embodiment, the Fc region comprises mutations H285D/T307Q/A378V and a mutation or a combination of mutations capable of disrupting an Fc effector function, e.g., L234A/L235A. In an embodiment, the Fc region comprises mutations T307Q/Q311V/A378V and a mutation or a combination of mutations capable of disrupting an Fc effector function, e.g., L234A/L235A. In an embodiment, the Fc region comprises mutations T256D/N286D/T307R/Q311V/A378V and a mutation or a combination of mutations capable of disrupting an Fc effector function, e.g., L234A/L235A. In an embodiment, the Fc region comprises mutations T256D/T307R/Q311V and a mutation or a combination of mutations capable of disrupting an Fc effector function, e.g., L234A/L235A. Other exemplary Fc mutations are described, e.g., in International Application Publication No. WO2018/052556, U.S. Application Publication No. US2018/0037634, and Booth et al. MAbs. 2018; 10(7): 1098-1110, the contents of which are incorporated by reference in their entirety.

In an embodiment the Fc region comprises the Fc region of human IgG1, e.g., human IgG1 m3 allotype. In an embodiment, the Fc region comprises the mutation N297G. In an embodiment, the Fc region comprises the Fc region of human IgG1 allotype m3, human IgG1 allotype m3 comprising the mutation N297G and/or other mutations of the Fc region of human IgG1 allotype m3, or a fragment thereof. In an embodiment, the Fc region comprises the sequence of SEQ ID NO: 1003, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

Any of the mutations in the Fc region that extend half-life described herein can be used in combination with any Fc mutation capable of enhancing or disrupting an Fc effector function.

In an embodiment the Fc region comprises the Fc region of human IgG4, human IgG4 containing S228P mutation, and/or R409K mutation, and/or other mutations of the Fc region of human IgG4, or a fragment thereof. An exemplary fragment of an Fc region amino acid sequence from human IgG4 is provided in SEQ ID NO: 44 and is shown below:

(SEQ ID NO: 44)
E$_{219}$SKYGPPCP<u>P</u>$_{228}$CPAPEFLGGPSV$_{240}$FLFPPKPKDT$_{250}$LMI

SRTPEVT$_{260}$CVVVDVSQED$_{270}$PEVQFNWYVD$_{280}$GVEVHNAKTK$_{290}$

PREEQFNSTY$_{300}$RVVSVL<u>T</u>$_{307}$VLH<u>Q</u>$_{311}$DWLNGKEYK$_{320}$CKVSNK

GLPS$_{330}$SIEKTISKAK$_{340}$GQPREPQVYT$_{350}$LPPSQEEMTK$_{360}$NQ

VSLTCLVK$_{370}$GFYPSDI<u>A</u>$_{378}$VEWESNGQPENNYKTTPPVLDSDGSF

FLYSRLTVDKSRWQEGNVFSCSVMHEALHNHYTQKSLSLSLGK

In SEQ ID NO: 44, the first amino acid residue in this sequence is referred to as position 219 herein. Mutations described to extend the half-life of human IgG1 can be applied to human IgG4 Fc. For example, Mut215 corresponds to mutations T307Q/Q311V/A378V in SEQ ID NO: 44.

The Fc region can bind to various cell receptors (e.g., Fc receptors) and complement proteins. The Fc region can also mediate different physiological effects of antibody molecules, e.g., detection of opsonized particles; cell lysis; degranulation of mast cells, basophils, and eosinophils; and other processes.

There are several different types of Fc receptors (FcR), which can be classified based on the type of antibody that they recognize.

Fcγ receptors (FcγR) belong to the immunoglobulin superfamily, and are involved, e.g., in inducing phagocytosis of opsonized microbes. This family includes several members, FcγRI (CD64), FcγRIIA (CD32), FcγRIIB (CD32), FcγRIIIA (CD16a), FcγRIIIB (CD16b), which differ in their antibody affinities due to their different molecular structure. For instance, FcγRI can bind to IgG more strongly than FcγRII or FcγRIII does. FcγRI also has an extracellular portion comprising three immunoglobulin (Ig)-like domains, one more domain than FcγRII or FcγRIII has. This property allows FcγRI to bind a sole IgG molecule (or monomer), but Fcγ receptors generally need to bind multiple IgG molecules within an immune complex to be activated.

The Fcγ receptors differ in their affinity for IgG and the different IgG subclasses can have unique affinities for each of the Fcγ receptors. These interactions can be further tuned by the glycan (oligosaccharide) at certain position of IgG. For example, by creating steric hindrance, fucose containing CH2-84.4 glycans reduce IgG affinity for FcγRIIIA, whereas G0 glycans, which lack galactose and terminate instead with GlcNAc moieties, have increased affinity for FcγRIIIA (Maverakis et al. (2015) *Journal of Autoimmunity* 57 (6): 1-13).

The neonatal Fc receptor (FcRn) is expressed on multiple cell types and is similar in structure to MHC class I. This receptor also binds IgG and is involved in preservation of this antibody (Zhu et al. (2001). *Journal of Immunology* 166 (5): 3266-76.). FcRn is also involved in transferring IgG from a mother either via the placenta to her fetus or in milk to her suckling infant. This receptor may also play a role in the homeostasis of IgG serum levels.

FcαRI (or CD89) belongs to the FcαR subgroup. FcαRI is found on the surface of neutrophils, eosinophils, monocytes, macrophages (including Kupffer cells), and dendritic cells. It comprises two extracellular Ig-like domains and is a member of both the immunoglobulin superfamily and the multi-chain immune recognition receptor (MIRR) family. It signals by associating with two FcRγ signaling chains.

Fc-alpha/mu receptor (Fcα/μR) is a type I transmembrane protein. It can bind IgA, although it has higher affinity for IgM (Shibuya and Honda (2006) *Springer Seminars in Immunopathology* 28 (4): 377-82). With one Ig-like domain in its extracellular portion, this Fc receptor is also a member of the immunoglobulin superfamily.

There are two known types of FcεR. The high-affinity receptor FcεRI is a member of the immunoglobulin superfamily (it has two Ig-like domains). FcεRI is found on epidermal Langerhans cells, eosinophils, mast cells and basophils. This receptor can play a role in controlling allergic responses. FcεRI is also expressed on antigen-presenting cells, and controls the production of immune mediators, e.g., cytokines that promote inflammation (von Bubnoff et al. (2003) *Clinical and Experimental Dermatology* 28 (2): 184-7). The low-affinity receptor FcεRII (CD23) is a C-type lectin. FcεRII has multiple functions as a membrane-bound or soluble receptor. It can also control B cell growth and differentiation and blocks IgE-binding of eosinophils, monocytes, and basophils (Kikutani et al. (1989) *Ciba Foundation Symposium* 147: 23-31).

In an embodiment, the Fc region can be engineered to contain an antigen-binding site to generate an Fcab fragment (Wozniak-Knopp et al. (2010) *Protein Eng Des* 23 (4): 289-297). Fcab fragments can be inserted into a full immunoglobulin by swapping the Fc region, thus obtaining a bispecific antibody (with both Fab and Fcab regions containing distinct binding sites).

The binding and recycling of FcRn can be illustrated below. For example, IgG and albumin are internalized into vascular endothelial cells through pinocytosis. The pH of the endosome is 6.0, facilitating association with membrane-bound FcRn. The contents of endosomes can be processed in one of two ways: either recycling back to the apical cell membrane or transcytosis from the apical to the basolateral side. IgG not associated with FcRn is degraded by lysosomes.

While not wishing to be bound by theory, it is believed that FcRn interaction with IgG is mediated through Fc. The binding of Fc to FcRn is pH specific, e.g., no significant binding at pH 7.4 and strong binding in acidic environment. Structure of FcRn in complex with Fc domain of IgG1 molecule is described, e.g., in FIG. 1 of International Application Publication No. WO2018/052556 or U.S. Application Publication No. US2018/0037634. Each FcRn molecule generally binds to an Fc-monomer. In an embodiment, Fab domains can also influence binding of IgG to FcRn, e.g., have either a negative or no influence on the affinity of the IgG for FcRn.

There can be multiple considerations when an Fc region is engineered to enhance half-life of a polypeptide. For example, prolonging half-life and efficient recirculation of antibody molecules or fusion proteins often requires pH specific affinity enhancement (e.g., only at low pH of the endosome). FcRn binds proximal to the linker region between CH2 and CH3 domains of a Fc region. Modifications to the linker can impact Fc engagement with Fcγ receptors. Modifications on the Fc region can impact thermal stability and aggregation properties of the polypeptide.

Pharmaceutical Compositions and Kits

The present disclosure provides compositions, e.g., pharmaceutical compositions, which include an IL-2 agent described herein, and optionally a pharmaceutically acceptable carrier.

As used herein, "pharmaceutically acceptable carrier" includes any and all solvents, dispersion media, isotonic and absorption delaying agents, and the like that are physiologically compatible. The carrier can be suitable for intravenous, intramuscular, subcutaneous, parenteral, rectal, spinal or epidermal administration (e.g., by injection or infusion). In an embodiment, less than about 5%, e.g., less than about 4%, 3%, 2%, or 1% of the IL-2 agents in the composition are present as aggregates. In an embodiment, at least about 95%, e.g., at least about 96%, 97%, 98%, 98.5%, 99%, 99.5%, 99.8%, or more of the IL-2 agents in the composition are present as monomers. In an embodiment, at least about 95%, e.g., at least about 96%, 97%, 98%, 98.5%, 99%, 99.5%, 99.8%, or more of the IL-2 agents in the composition are present as dimers. In an embodiment, the level of aggregates, dimers, or monomers is determined by chromatography, e.g., high performance liquid chromatography size exclusion chromatography (HPLC-SEC). In an embodiment, the IL-2 agent is formulated together with the pharmaceutically acceptable carrier.

The compositions set out herein may be in a variety of forms. These include, for example, liquid, semi-solid and solid dosage forms, such as liquid solutions (e.g., injectable and infusible solutions), dispersions or suspensions, liposomes, and suppositories. A suitable form depends on the intended mode of administration and therapeutic application. Typical suitable compositions are in the form of injectable or infusible solutions. One suitable mode of administration is parenteral (e.g., intravenous, subcutaneous, intraperitoneal, intramuscular). In an embodiment, the IL-2 agent is administered by intravenous infusion or injection. In another embodiment, the IL-2 agent is administered by intramuscular or subcutaneous injection. In an embodiment, the IL-2 agent is administered subcutaneously (e.g., presented in an autoinjector or prefilled syringe).

The terms "parenteral administration" and "administered parenterally" as used herein means modes of administration other than enteral and topical administration, usually by injection, and includes, without limitation, intravenous, intramuscular, intraarterial, intrathecal, intracapsular, intraorbital, intracardiac, intradermal, intraperitoneal, transtracheal, subcutaneous, subcuticular, intraarticular, subcapsular, subarachnoid, intraspinal, epidural and intrasternal injection and infusion.

Pharmaceutical compositions (e.g., for therapeutic applications) typically should be sterile and stable under the conditions of manufacture and storage. The composition can be formulated as a solution, microemulsion, dispersion, liposome, or other ordered structure suitable to high antibody concentration. Sterile injectable solutions can be prepared by incorporating the active compound (i.e., antibody or antibody portion) in the required amount in an appropriate solvent with one or a combination of ingredients enumerated above, as required, followed by filtered sterilization. Generally, dispersions are prepared by incorporating the active compound into a sterile vehicle that contains a basic dispersion medium and the required other ingredients from those enumerated above. In the case of sterile powders for the preparation of sterile injectable solutions, the preferred methods of preparation are vacuum drying and freeze-drying that yields a powder of the active ingredient plus any additional desired ingredient from a previously sterile-filtered solution thereof. The proper fluidity of a solution can be maintained, for example, by the use of a coating such as lecithin, by the maintenance of the required particle size in the case of dispersion and by the use of surfactants. Prolonged absorption of injectable compositions can be brought about by including in the composition an agent that delays absorption, for example, monostearate salts and gelatin.

The IL-2 agents described herein can be administered by a variety of methods. Several are known in the art, and for many therapeutic, prophylactic, or diagnostic applications, an appropriate route/mode of administration is intravenous injection or infusion. For example, the IL-2 agents can be administered by intravenous infusion at a rate of less than 10 mg/min; preferably less than or equal to 5 mg/min to reach a dose of about 1 to 100 mg/m$^2$, preferably about 5 to 50 mg/m$^2$, about 7 to 25 mg/m$^2$ and more preferably, about 10 mg/m$^2$. As will be appreciated by the skilled artisan, the route and/or mode of administration will vary depending upon the desired results. In certain embodiments, the active compound may be prepared with a carrier that will protect the compound against rapid release, such as a controlled release formulation, including implants, transdermal patches, and microencapsulated delivery systems. Biodegradable, biocompatible polymers can be used, such as ethylene vinyl acetate, polyanhydrides, polyglycolic acid, collagen, polyorthoesters, and polylactic acid. Many methods for the preparation of such formulations are patented or generally known to those skilled in the art. See, e.g., *Sustained and Controlled Release Drug Delivery Systems*, J. R. Robinson, ed., Marcel Dekker, Inc., New York, 1978.

In an embodiment, the IL-2 agent is orally administered, for example, with an inert diluent or an assimilable edible carrier. The IL-2 agent (and other ingredients, if desired) may also be enclosed in a hard or soft shell gelatin capsule, compressed into tablets, or incorporated directly into the subject's diet. For oral therapeutic administration, the IL-2 agent may be incorporated with excipients and used in the form of ingestible tablets, buccal tablets, troches, capsules, elixirs, suspensions, syrups, wafers, and the like. To administer an IL-2 agent by other than parenteral administration, it may be necessary to coat the compound with, or co-administer the compound with, a material to prevent its inactivation. Therapeutic, prophylactic, or diagnostic compositions can also be administered with medical devices, and several are known in the art.

Dosage regimens are adjusted to provide the desired response (e.g., a therapeutic, prophylactic, or diagnostic response). For example, a single bolus may be administered, several divided doses may be administered over time or the dose may be proportionally reduced or increased as indicated by the exigencies of the therapeutic situation. It is especially advantageous to formulate parenteral compositions in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier. The specification for the dosage unit forms are dictated by and directly dependent on (a) the unique characteristics of the antibody molecule and the particular therapeutic, prophylactic, or diagnostic effect to be achieved, and (b) the limitations inherent in the art of compounding such an antibody molecule for the treatment of sensitivity in individuals.

An exemplary, non-limiting range for a therapeutically, prophylactically, or diagnostically effective amount of an IL-2 agent is about 0.1-50 mg/kg, e.g., about 0.1-30 mg/kg, e.g., about 1-30, 1-15, 1-10, 1-5, 5-10, or 1-3 mg/kg, e.g., about 1, 2, 3, 4, 5, 6, 7, 8, 9, 10, 15, 20, 30, 40, or 50 mg/kg. The IL-2 agent can be administered by intravenous infusion at a rate of less than 10 mg/min, e.g., less than or equal to 5 mg/min to reach a dose of about 1 to 100 mg/m², e.g., about 5 to 50 mg/m², about 7 to 25 mg/m², e.g., about 10 mg/m². It is to be noted that dosage values may vary with the type and severity of the condition to be alleviated. It is to be further understood that for any particular subject, specific dosage regimens should be adjusted over time according to the individual need and the professional judgment of the person administering or supervising the administration of the compositions, and that dosage ranges set forth herein are exemplary only and are not intended to limit the scope or practice of the claimed compositions.

The pharmaceutical compositions herein may include a "therapeutically effective amount," "prophylactically effective amount," or "diagnostically effectively amount" of an IL-2 agent described herein.

A "therapeutically effective amount" refers to an amount effective, at dosages and for periods of time necessary, to achieve the desired therapeutic result. A therapeutically effective amount of the polypeptide (e.g., antibody molecule or fusion protein) may vary according to factors such as the disease state, age, sex, and weight of the individual, and the ability of the antibody or antibody portion to elicit a desired response in the individual. A therapeutically effective amount is also one in which any toxic or detrimental effect of the antibody molecule is outweighed by the therapeutically beneficial effects. A "therapeutically effective dosage" typically inhibits a measurable parameter by at least about 20%, e.g., by at least about 40%, by at least about 60%, or by at least about 80% relative to untreated subjects. The measurable parameter may vary, e.g., based on the disordered being treated. The ability of an IL-2 agent to inhibit a measurable parameter can be evaluated in an animal model system predictive of efficacy in treating or preventing a disorder described herein. Alternatively, this property of a composition can be evaluated by examining the ability of the IL-2 agent to modulate a biological function of a target molecule or cell, e.g., by an in vitro assay.

A "prophylactically effective amount" refers to an amount effective, at dosages and for periods of time necessary, to achieve the desired prophylactic result. Typically, since a prophylactic dose is used in subjects prior to or at an earlier stage of disease, the prophylactically effective amount will be less than the therapeutically effective amount.

A "diagnostically effective amount" refers to an amount effective, at dosages and for periods of time necessary, to achieve the desired diagnostic result. Typically, a diagnostically effective amount is one in which a disorder, e.g., a disorder described herein, can be diagnosed in vitro, ex vivo, or in vivo.

In an embodiment, the pharmaceutical composition is a good manufacturing practices (GMP)-grade pharmaceutical composition. In an embodiment, the pharmaceutical composition has greater than 99% purity, e.g., greater than 99.5%, 99.8%, or 99.9% purity. In an embodiment, greater than 50%, 60%, 70%, 80%, 90%, 95%, 98%, or 99% of the contaminants in the pharmaceutical composition are removed. In an embodiment, the pharmaceutical composition is in large scale, e.g., at least 20 g, 30 g, 40 g, 50 g, 100 g, 200 g, 300 g, 400 g, 500 g, 600 g, 700 g, 800 g, 900 g, 1000 g, or more.

The disclosure also provides kits that comprise IL-2 agents described herein. The kits can include one or more other elements including: instructions for use; other reagents, e.g., a label, a therapeutic agent, or an agent useful for chelating, or otherwise coupling, an antibody molecule coupled to a label or therapeutic agent, or a radioprotective composition; devices or other materials for preparing the IL-2 agent for administration; pharmaceutically acceptable carriers; and devices or other materials for administration to a subject.

Nucleic Acids

The present disclosure also provides nucleic acids comprising a nucleotide sequence that encodes an IL-2 agent described herein.

In an embodiment, the nucleic acid comprises a nucleotide sequence encoding an amino acid sequence of an IL-2 variant described herein, or a nucleotide sequence substantially identical thereto (e.g., a sequence at least about 85%, 90%, 95%, 99% or more identical thereto, and/or capable of hybridizing under the stringency conditions described herein). In an embodiment, the nucleic acid comprises a nucleotide sequence encoding an IL-2 variant comprising one or more of the mutations described herein.

In an embodiment, the nucleic acid further comprises a nucleotide sequence encoding an Fc region, e.g., an Fc region described herein, or having a nucleotide sequence substantially identical thereto (e.g., a sequence at least about 85%, 90%, 95%, 99% or more identical thereto, and/or capable of hybridizing under the stringency conditions described herein). In an embodiment, the Fc region comprises one or more mutations, e.g., one or more mutations described herein. In an embodiment, the nucleic acid comprises from 5' to 3' a nucleotide sequence encoding an IL-2 variant described herein and a nucleotide sequence encoding an Fc region described herein.

In another embodiment, the nucleic acid further comprises a nucleotide sequence encoding a linker, e.g., a linker described herein, or a nucleotide sequence substantially homologous thereto (e.g., a sequence at least about 85%, 90%, 95%, 99% or more identical thereto, and/or capable of hybridizing under the stringency conditions described herein). In an embodiment, the nucleic acid comprises from 5' to 3' a nucleotide sequence encoding an IL-2 variant described herein and a nucleotide sequence encoding a linker described herein. In an embodiment, the nucleic acid comprises from 5' to 3' a nucleotide sequence encoding a linker described herein, and a nucleotide sequence encoding an Fc region described herein.

In another embodiment, the nucleic acid comprises a nucleotide sequence encoding an IL-2 fusion protein, e.g., an IL-2 fusion protein described herein, or a nucleotide sequence substantially homologous thereto (e.g., a sequence at least about 85%, 90%, 95%, 99% or more identical thereto, and/or capable of hybridizing under the stringency conditions described herein). In an embodiment, the nucleic acid encoding the IL-2 fusion protein comprises from 5' to 3' a nucleotide sequence encoding an IL-2 variant described herein and a nucleotide sequence encoding an Fc region described herein. In an embodiment, the nucleic acid encoding the IL-2 fusion protein comprises from 5' to 3' a nucleotide sequence encoding an IL-2 variant described herein, a nucleotide sequence encoding a linker described herein, and a nucleotide sequence encoding an Fc region described herein.

In an embodiment, the nucleic acid comprises a portion of a nucleotide sequence described herein. The portion may encode, for example, one, two, or all of an IL-2 variant, a linker, or an Fc region.

In an embodiment, the nucleic acid comprises a nucleotide sequence encoding an amino acid sequence described in Table 9, or a functional fragment thereof. In an embodiment, the nucleic acid comprises a nucleotide sequence described in Table 10.

In an embodiment, the nucleic acid comprises a nucleotide sequence encoding the amino acid sequence of any of SEQ ID NOs: 2-38 or 1000-1002, or a functional fragment thereof. In an embodiment, the nucleic acid comprises a nucleotide sequence encoding the amino acid sequence of any of SEQ ID NOs: 56-359 or 1004-1009, or a functional fragment thereof.

In an embodiment, the nucleic acid comprises a nucleotide sequence of any of SEQ ID NOs: 361-398 or 1010-1012, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, 30, 35, 40, 45, or 50 nucleotides thereto. In an embodiment, the nucleic acid further comprises a nucleotide sequence of any of SEQ ID NOs: 399-407 or 1013, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 nucleotides thereto. In an embodiment, the nucleic acid further comprises a nucleotide sequence of any of SEQ ID NOs: 408-415.

In an embodiment, the nucleic acid comprises a nucleotide sequence of any of SEQ ID NOs: 416-481 or 1014-1019, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, 30, 35, 40, 45, 50, 55, 60, 65, 70, 75, 80, 85, 90, 95, or 100 nucleotides thereto. In an embodiment, the nucleic acid comprises a nucleotide sequence of any of SEQ ID NOs: 416-453 or 1014-1019. In an embodiment, the nucleic acid comprises a nucleotide sequence of any of SEQ ID NOs: 454-491. In an embodiment, the nucleic acid comprises a nucleotide sequence of any of SEQ ID NOs: 492-529. In an embodiment, the nucleic acid comprises a nucleotide sequence of any of SEQ ID NOs: 416-453. In an embodiment, the nucleic acid comprises a nucleotide sequence of any of SEQ ID NOs: 454-491. In an embodiment, the nucleic acid comprises a nucleotide sequence of any of SEQ ID NOs: 492-529. In an embodiment, the nucleic acid comprises a nucleotide sequence of any of SEQ ID NOs: 530-567. In an embodiment, the nucleic acid comprises a nucleotide sequence of any of SEQ ID NOs: 568-605. In an embodiment, the nucleic acid comprises a nucleotide sequence of any of SEQ ID NOs: 606-643. In an embodiment, the nucleic acid comprises a nucleotide sequence of any of SEQ ID NOs: 644-681.

In an embodiment, the nucleic acid comprises the nucleotide sequence of any of SEQ ID NOs: 364, 365, 371, or 1010-1012, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, 30, 35, 40, 45, or 50 nucleotides thereto. In an embodiment, the nucleic acid comprises the nucleotide sequence of SEQ ID NO: 364. In an embodiment, the nucleic acid comprises the nucleotide sequence of SEQ ID NO: 365. In an embodiment, the nucleic acid comprises the nucleotide sequence of SEQ ID NO: 371. In an embodiment, the nucleic acid comprises the nucleotide sequence of SEQ ID NO: 1010. In an embodiment, the nucleic acid comprises the nucleotide sequence of SEQ ID NO: 1011. In an embodiment, the nucleic acid comprises the nucleotide sequence of SEQ ID NO: 1012.

In an embodiment, the nucleic acid further comprises the nucleotide sequence of SEQ ID NO: 1013, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 nucleotides thereto. In an embodiment, the nucleic acid further comprises the nucleotide sequence of SEQ ID NO: 48.

In an embodiment, the nucleic acid comprises the nucleotide sequence of any of SEQ ID NOs: 1014-1017, or a nucleotide sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, 30, 35, 40, 45, or 50 nucleotides thereto. In an embodiment, the nucleic acid comprises the nucleotide sequence of SEQ ID NO: 1014. In an embodiment, the nucleic acid comprises the nucleotide sequence of SEQ ID NO: 1015. In an embodiment, the nucleic acid comprises the nucleotide sequence of SEQ ID NO: 1016. In an embodiment, the nucleic acid comprises the nucleotide sequence of SEQ ID NO: 1017. In an embodiment, the nucleic acid comprises the nucleotide sequence of SEQ ID NO: 1018. In an embodiment, the nucleic acid comprises the nucleotide sequence of SEQ ID NO: 1019.

In an embodiment, the nucleic acid comprises the nucleotide sequence of SEQ ID NO: 364. In an embodiment, the nucleic acid comprises the nucleotide sequence of SEQ ID NO: 365. In an embodiment, the nucleic acid comprises the nucleotide sequence of SEQ ID NO: 371. In an embodiment, the nucleic acid comprises the nucleotide sequence of SEQ ID NO: 1010. In an embodiment, the nucleic acid comprises the nucleotide sequence of SEQ ID NO: 1011. In an embodiment, the nucleic acid comprises the nucleotide sequence of SEQ ID NO: 1012. In an embodiment, the nucleic acid further comprises the nucleotide sequence of SEQ ID NO: 1013. In an embodiment, the nucleic acid further comprises the nucleotide sequence of SEQ ID NO: 48. In an embodiment, the nucleic acid comprises the nucleotide sequence of SEQ ID NO: 1014. In an embodiment, the nucleic acid comprises the nucleotide sequence of SEQ ID NO: 1015. In an embodiment, the nucleic acid comprises the nucleotide sequence of SEQ ID NO: 1016. In an embodiment, the nucleic acid comprises the nucleotide sequence of SEQ ID NO: 1017. In an embodiment, the nucleic acid comprises the nucleotide sequence of SEQ ID NO: 1018. In an embodiment, the nucleic acid comprises the nucleotide sequence of SEQ ID NO: 1019.

The nucleic acids disclosed herein include deoxyribonucleotides or ribonucleotides, or analogs thereof. The polynucleotide may be either single-stranded or double-stranded, and if single-stranded may be the coding strand or non-coding (antisense) strand. A polynucleotide may comprise modified nucleotides, such as methylated nucleotides and nucleotide analogs. The sequence of nucleotides may be interrupted by non-nucleotide components. A polynucleotide may be further modified after polymerization, such as by conjugation with a labeling component. The nucleic acid may be a recombinant polynucleotide, or a polynucleotide of genomic, cDNA, semisynthetic, or synthetic origin which either does not occur in nature or is linked to another polynucleotide in a non-natural arrangement.

In an aspect, the disclosure features host cells and vectors comprising the nucleic acids described herein. The nucleic acids may be present in a single vector or separate vectors present in the same host cell or separate host cell, as described in more detail below.

In an aspect, the disclosure features methods of treating a disorder (e.g., a disorder described herein) comprising administering to a subject in need thereof an effective amount of a nucleic acid described herein.

Vectors

The present disclosure features vectors that comprises a nucleotide sequence encoding an IL-2 agent described herein. In an embodiment, the vector comprises a nucleic acid described herein (e.g., in Table 10).

In an embodiment, the vector comprises a nucleotide sequence encoding an amino acid sequence of an IL-2 variant described herein (e.g., in Table 9), or a nucleotide sequence substantially identical thereto (e.g., a sequence at least about 85%, 90%, 95%, 99% or more identical thereto, and/or capable of hybridizing under the stringency conditions described herein). In an embodiment, the vector comprises a nucleotide sequence encoding an IL-2 variant comprising one or more of the mutations described herein.

In an embodiment, the vector further comprises a nucleotide sequence encoding an Fc region, e.g., an Fc region described herein, or having a nucleotide sequence substantially identical thereto (e.g., a sequence at least about 85%, 90%, 95%, 99% or more identical thereto, and/or capable of hybridizing under the stringency conditions described herein). In an embodiment, the Fc region comprises one or more mutations, e.g., one or more mutations described herein. In an embodiment, the vector comprises from 5' to 3' a nucleotide sequence encoding an IL-2 variant described herein and a nucleotide sequence encoding an Fc region described herein.

In another embodiment, the vector further comprises a nucleotide sequence encoding a linker, e.g., a linker described herein, or a nucleotide sequence substantially homologous thereto (e.g., a sequence at least about 85%, 90%, 95%, 99% or more identical thereto, and/or capable of hybridizing under the stringency conditions described herein). In an embodiment, the vector comprises from 5' to 3' a nucleotide sequence encoding an IL-2 variant described herein and a nucleotide sequence encoding a linker described herein. In an embodiment, the vector comprises from 5' to 3' a nucleotide sequence encoding a linker described herein, and a nucleotide sequence encoding an Fc region described herein.

In another embodiment, the vector comprises a nucleotide sequence encoding an IL-2 fusion protein, e.g., an IL-2 fusion protein described herein, or a nucleotide sequence substantially homologous thereto (e.g., a sequence at least about 85%, 90%, 95%, 99% or more identical thereto, and/or capable of hybridizing under the stringency conditions described herein). In an embodiment, the vector encoding the IL-2 fusion protein comprises from 5' to 3' a nucleotide sequence encoding an IL-2 variant described herein and a nucleotide sequence encoding an Fc region described herein. In an embodiment, the vector encoding the IL-2 fusion protein comprises from 5' to 3' a nucleotide sequence encoding an IL-2 variant described herein, a nucleotide sequence encoding a linker described herein, and a nucleotide sequence encoding an Fc region described herein.

In an embodiment, the vector further comprises a nucleotide sequence encoding a heavy chain variable region of an anti-IL-2 antibody molecule, e.g., an anti-IL-2 antibody molecule described herein. In an embodiment, the vector further comprises a nucleotide sequence encoding a light chain variable region of an anti-IL-2 antibody molecule, e.g., an anti-IL-2 antibody molecule described herein. In yet another embodiment, the vector further comprises a nucleotide sequence encoding a heavy chain variable region and a light chain variable region of an anti-IL-2 antibody molecule, e.g., an anti-IL-2 antibody molecule described herein.

In an embodiment, the vector further comprises a nucleotide sequence encoding at least one, two, or three CDRs from a heavy chain variable region of an anti-IL-2 antibody molecule, e.g., an anti-IL-2 antibody molecule described herein. In another embodiment, the vector further comprises a nucleotide sequence encoding at least one, two, or three CDRs from a light chain variable region of an anti-IL-2 antibody molecule, e.g., an anti-IL-2 antibody molecule described herein. In yet another embodiment, the vector comprises a nucleotide sequence encoding at least one, two, three, four, five, or six CDRs from heavy and light chain variable regions of an anti-IL-2 antibody molecule, e.g., an anti-IL-2 antibody molecule described herein.

In an embodiment, the vector comprises a portion of a nucleotide sequence described herein. The portion may encode, for example, an IL-2 variant; a liker an Fc region; a variable region (e.g., VH or VL); one, two, or three or more (e.g., four, five, or six) CDRs; or one, two, three, or four or more framework regions.

The vectors include, but are not limited to, a virus, plasmid, cosmid, lambda phage or a yeast artificial chromosome (YAC).

Numerous vector systems can be employed. For example, one class of vectors utilizes DNA elements which are derived from animal viruses such as, for example, bovine papilloma virus, polyoma virus, adenovirus, vaccinia virus, baculovirus, retroviruses (Rous Sarcoma Virus, MMTV or MOMLV) or SV40 virus. Another class of vectors utilizes RNA elements derived from RNA viruses such as Semliki Forest virus, Eastern Equine Encephalitis virus and Flaviviruses.

Additionally, cells which have stably integrated the DNA into their chromosomes may be selected by introducing one or more markers which allow for the selection of transfected host cells. The marker may provide, for example, prototropy to an auxotrophic host, biocide resistance (e.g., antibiotics), or resistance to heavy metals such as copper, or the like. The selectable marker gene can be either directly linked to the DNA sequences to be expressed or introduced into the same cell by cotransformation. Additional elements may also be needed for optimal synthesis of mRNA. These elements may include splice signals, as well as transcriptional promoters, enhancers, and termination signals.

Once the expression vector or DNA sequence containing the constructs has been prepared for expression, the expression vectors may be transfected or introduced into an appropriate host cell. Various techniques may be employed to achieve this, such as, for example, protoplast fusion, calcium phosphate precipitation, electroporation, retroviral transduction, viral transfection, gene gun, lipid based transfection or other conventional techniques. In the case of protoplast fusion, the cells are grown in media and screened for the appropriate activity.

Methods and conditions for culturing the resulting transfected cells and for recovering the polypeptides (e.g., IL-2 variants or IL-2 fusion proteins) produced are known to those skilled in the art and may be varied or optimized depending upon the specific expression vector and mammalian host cell employed, based upon the present description.

Cells

The present disclosure also provides cells comprising a nucleic acid or vector encoding an IL-2 agent described herein.

In an embodiment, the cell is a host cell. For example, the host cell can comprise an IL-2 agent engineered in accordance with a method described herein. In an embodiment, the cell is an isolated cell. In an embodiment, the cell is a cultured cell.

In an embodiment, the cell comprises a nucleic acid comprising a nucleotide sequence encoding an IL-2 agent described herein (e.g., in Table 10), a nucleotide sequence substantially homologous thereto (e.g., a sequence at least about 85%, 90%, 95%, 99% or more identical thereto, and/or capable of hybridizing under the stringency conditions described herein), or a portion of the aforesaid nucleic acid. In an embodiment, the cell comprises a vector comprising a nucleotide sequence encoding an IL-2 agent described herein, a nucleotide sequence substantially homologous thereto (e.g., a sequence at least about 85%, 90%, 95%, 99% or more identical thereto, and/or capable of hybridizing under the stringency conditions described herein), or a portion of the aforesaid vector.

In an embodiment, the cell is genetically engineered to comprise a nucleic acid or vector encoding an IL-2 agent described herein. In an embodiment, the host cells are genetically engineered by using an expression cassette. The phrase "expression cassette," refers to nucleotide sequences, which are capable of affecting expression of a gene in hosts compatible with such sequences. Such cassettes may include a promoter, an open reading frame with or without introns, and a termination signal. Additional factors necessary or helpful in effecting expression may also be used, for example, an inducible promoter.

The cell can be, but is not limited to, a eukaryotic cell, a bacterial cell, an insect cell, or a human cell. Suitable eukaryotic cells include, but are not limited to, Vero cells, HeLa cells, COS cells, CHO cells, HEK293 cells, BHK cells and MDCKII cells. Suitable insect cells include, but are not limited to, Sf9 cells.

Uses of IL-2 Agents

The IL-2 agents (e.g., IL-2 variants, fusion polypeptides, complexes, or immunoconjugates) described herein, as well as the compositions described herein and the nucleic acids described herein, have in vitro, ex vivo, and in vivo therapeutic, prophylactic, and/or diagnostic utilities.

In an embodiment, the IL-2 agent modulates (e.g., reduces (e.g., inhibits, blocks, or neutralizes) or increases (e.g., activates, initiates, or enhances)) one or more biological activities associated with IL-2. For example, these IL-2 agents can be administered to cells in culture, in vitro or ex vivo, or to a subject, e.g., a human subject, e.g., in vivo, to modulate one or more biological activities associated with IL-2. Accordingly, in an aspect, the disclosure provides a method of treating, preventing, or diagnosing a disorder, e.g., a disorder described herein, in a subject, comprising administering to the subject an IL-2 agent described herein, such that the disorder is treated, prevented, or diagnosed. For example, the disclosure provides a method comprising contacting the IL-2 agent described herein with cells in culture, e.g. in vitro or ex vivo, or administering the IL-2 agent described herein to a subject, e.g., in vivo, to treat, prevent, or diagnose a disorder, e.g., a disorder associated with IL-2 (e.g., a disorder described herein).

As used herein, the term "subject" is intended to include human and non-human animals. In an embodiment, the subject is a human subject, e.g., a human patient having a disorder described herein, or at risk of having a disorder described herein. The term "non-human animals" includes mammals and non-mammals, such as non-human primates. In an embodiment, the subject is a human. The methods and compositions described herein are suitable for treating human patients for a disorder described herein. Patients having a disorder described herein include those who have developed a disorder described herein but are (at least temporarily) asymptomatic, patients who have exhibited a symptom of a disorder described herein, or patients having a disorder related to or associated with a disorder described herein.

Without wishing to be bound by theory, it is believed that in an embodiment, the IL-2 agents described herein selectively stimulate regulatory T cells (Tregs). For example, the IL-2 agents described herein can promotes the proliferation, survival, activation, and/or function of CD3+FoxP3+ T cells over CD3+FoxP3− T cells. Methods of measuring the ability to selectively stimulate Tregs can be measured by flow cytometry of peripheral blood leukocytes, in which there is an observed increase in the percentage of FOXP3+CD4+ T cells among total CD4+ T cells, an increase in percentage of FOXP3+CD8+ T cells among total CD8+ T cells, an increase in percentage of FOXP3+ T cells relative to NK cells, and/or a greater increase in the expression level of CD25 on the surface of FOXP3+ T cells relative to the increase of CD25 expression on other T cells. Preferential growth of Treg cells can also be detected as increased representation of demethylated FOXP3 promoter DNA (i.e. the Treg-specific demethylated region, or TSDR) relative to demethylated CD3 genes in DNA extracted from whole blood, as detected by sequencing of polymerase chain reaction (PCR) products from bisulfite-treated genomic DNA (J. Sehouli, et al. 2011. *Epigenetics* 6:2, 236-246). Without wishing to be bound by theory, it is believed that in an embodiment, the IL-2 agents described agents can achieve immune modulation through selective activation of regulatory T cells, resulting in T reg stimulation with minimal effect on T effector and NK cells. The IL-2 agents described herein are particularly suitable for treating autoimmune and inflammatory diseases, e.g., primarily mediated by Effector T cell activation (e.g., lupus nephritis, autoimmune hepatitis, nephrotic syndrome). In an embodiment, the IL-2 agent results in immune modulation without immunosuppression, which is highly desired in an IL-2 therapy.

In an aspect, the disclosure provides a method of increasing the ratio of regulatory T cells (Tregs) to non-regulatory T cells (non-Tregs) within a population of T cells, comprising contacting the population of T cells with an effective amount of an IL-2 agent described herein.

In an embodiment, the IL-2 agent selectively increases the ratio of Tregs over non-Tregs by about 20%, 30%, 40%, 50%, 60%, 70%, 80%, 90%, 100%, or more, or about 2, 3, 4, 5, 6, 7, 8, 9, 10-fold or more. In an embodiment, the IL-2 agent selectively increases the ratio of CD3+FoxP3+ cells to CD3+FoxP3− cells by about 20%, 30%, 40%, 50%, 60%, 70%, 80%, 90%, 100%, or more, or about 2, 3, 4, 5, 6, 7, 8, 9, 10-fold or more.

In an aspect, the disclosure provides a method of increasing the ratio of regulatory T cells (Tregs) to non-regulatory T cells (non-Tregs) in a subject (e.g., in the peripheral blood of a subject), comprising contacting the subject or sample with an effective amount of an IL-2 agent described herein.

In an embodiment, the IL-2 agent selectively increases the ratio of Tregs over non-Tregs in the subject, or in a sample (e.g., a peripheral blood sample) from the subject, by about 20%, 30%, 40%, 50%, 60%, 70%, 80%, 90%, 100%, or more, or about 2, 3, 4, 5, 6, 7, 8, 9, 10-fold or more. In an embodiment, the IL-2 agent selectively increases the ratio of CD3+FoxP3+ cells to CD3+FoxP3-cells in the subject, or in a sample (e.g., a peripheral blood sample) from the subject, by about 20%, 30%, 40%, 50%, 60%, 70%, 80%, 90%, 100%, or more, or about 2, 3, 4, 5, 6, 7, 8, 9, 10-fold or more.

In an aspect, the disclosure provides a method of increasing the ratio of regulatory T cells (Tregs) to natural killer cells (NKs) in a subject (e.g., in the peripheral blood of a subject), comprising contacting the subject or sample with an effective amount of an IL-2 agent described herein.

In an embodiment, the IL-2 agent selectively increases the ratio of Tregs over NKs in the subject, or in a sample (e.g., a peripheral blood sample) from the subject, by about 20%, 30%, 40%, 50%, 60%, 70%, 80%, 90%, 100%, or more, or about 2, 3, 4, 5, 6, 7, 8, 9, 10-fold or more. In an embodiment, the IL-2 agent selectively increases the ratio of CD3+FoxP3+ cells to CD3-CD19-lymphocytes expressing CD56 and/or CD16 in the subject, or in a sample (e.g., a peripheral blood sample) from the subject, by about 20%, 30%, 40%, 50%, 60%, 70%, 80%, 90%, 100%, or more, or about 2, 3, 4, 5, 6, 7, 8, 9, 10-fold or more.

Methods of Treating or Preventing Disorders

The IL-2 agents (e.g., IL-2 variants, fusion polypeptides, complexes, or immunoconjugates) described herein, as well as the pharmaceutical compositions disclosed herein and the nucleic acids described herein, can be used to treat or prevent various disorders or conditions.

In an embodiment, the disorder is an immune disorder, e.g., an autoimmune disease. In an embodiment, the disorder is a cancer. In an embodiment, the disorder is an infectious disease.

The IL-2 agents described herein can have an optimal or improved half-life, which can be desirable for treating or preventing a wide range of disorders or conditions. While not wishing to be bound by theory, it is believed that in an embodiment, the IL-2 agents described herein can provide one or more benefits over another IL-2 agent having the same or similar binding affinity and/or specificity (e.g., an IL-2 agent that does not have, or has not been engineered to have, an optimal or improved half-life). These benefits can include, but are not limited to, an increased therapeutic or preventive efficacy, a reduced dosage regimen, or an improved pharmacokinetic property. In an embodiment, the IL-2 includes a mutated Fc region as described herein.

In an embodiment, the ratio of regulatory T cells (Tregs) to non-regulatory T cells within the subject (e.g., in the peripheral blood of the subject) increases after the administration. In an embodiment, the ratio of regulatory T cells (Tregs) to non-regulatory T cells within the subject (e.g., in the peripheral blood of the subject) remains essentially the same after the administration. In an embodiment, the method further comprises identifying a subject who needs an increased level of Tregs. In an embodiment, the method further comprises determining the level of Tregs in the subject prior to and/or after the administration.

Exemplary immune disorders or conditions that can be treated or prevented by the IL-2 agents described herein include, but are not limited to, Addison's disease, agammaglobulinemia, alopecia areata, amyloidosis, ankylosing spondylitis, anti-GBM/anti-TBM nephritis, antiphospholipid syndrome (APS), autoimmune hepatitis, autoimmune inner ear disease (AIED), axonal & neuronal neuropathy (AMAN), Behcet's disease, Bullous pemphigoid, Castleman disease (CD), Celiac disease, Chagas disease, chronic inflammatory demyelinating polyneuropathy (CIDP), chronic recurrent multifocal osteomyelitis (CRMO), Churg-Strauss, Cicatricial pemphigoid/benign mucosal pemphigoid, Cogan's syndrome, Cold agglutinin disease, Congenital heart block, Coxsackie myocarditis, CREST syndrome, Crohn's disease, dermatitis herpetiformis, dermatomyositis, Devic's disease (neuromyelitis optica), Discoid lupus, Dressler's syndrome, endometriosis, eosinophilic esophagitis (EoE), eosinophilic fasciitis, erythema nodosum, essential mixed cryoglobulinemia, Evans syndrome, fibromyalgia, fibrosing alveolitis, giant cell arteritis (temporal arteritis), giant cell myocarditis, Glomerulonephritis, Goodpasture's syndrome, Granulomatosis with Polyangiitis, Graft-versus-host disease (GvHD), Graves' disease, Guillain-Barre syndrome, Hashimoto's thyroiditis, hemolytic anemia, Henoch-Schonlein purpura (HSP), herpes gestationis or pemphigoid gestationis (PG), hypogammalglobulinemia, IgA nephropathy, IgG4-related sclerosing disease, inclusion body myositis (IBM), interstitial cystitis (IC), juvenile arthritis, juvenile diabetes (Type 1 diabetes), juvenile myositis (JM), Kawasaki disease, Lambert-Eaton syndrome, leukocytoclastic vasculitis, Lichen planus, Lichen sclerosus, Ligneous conjunctivitis, linear IgA disease (LAD), lupus (e.g., systemic lupus erythematosus (SLE) or lupus nephritis), Lyme disease chronic, Membranous neuropathy, Meniere's disease, microscopic polyangiitis (MPA), mixed connective tissue disease (MCTD), Mooren's ulcer, Mucha-Habermann disease, multiple sclerosis (MS), Myasthenia gravis, Myositis, Narcolepsy, nephrotic syndrome, Neuromyelitis optica, neutropenia, ocular cicatricial pemphigoid, optic neuritis, palindromic rheumatism (PR), PANDAS (Pediatric Autoimmune Neuropsychiatric Disorders Associated with *Streptococcus*), paraneoplastic cerebellar degeneration (PCD), Paroxysmal nocturnal hemoglobinuria (PNH), Parry Romberg syndrome, Pars planitis (peripheral uveitis), Parsonnage-Turner syndrome, Pemphigus, peripheral neuropathy, Perivenous encephalomyelitis, pernicious anemia (PA), POEMS syndrome (polyneuropathy, organomegaly, endocrinopathy, monoclonal gammopathy, skin changes), polyarteritis *nodosa*, polymyalgia rheumatica, polymyositis, postmyocardial infarction syndrome, postpericardiotomy syndrome, primary biliary cirrhosis, primary sclerosing cholangitis, progesterone dermatitis, psoriasis, psoriatic arthritis, pure red cell aplasia (PRCA), pyoderma gangrenosum, Raynaud's phenomenon, Reactive Arthritis, Reflex sympathetic dystrophy, Reiter's syndrome, relapsing polychondritis, restless legs syndrome (RLS), retroperitoneal fibrosis, rheumatic fever, rheumatoid arthritis (RA), sarcoidosis, Schmidt syndrome, scleritis, scleroderma, Sjogren's syndrome, sperm & testicular autoimmunity, Stiff person syndrome (SPS), subacute bacterial endocarditis (SBE), Susac's syndrome, sympathetic ophthalmia (SO), Takayasu's arteritis, temporal arteritis/Giant cell arteritis, thrombocytopenic purpura (TTP), Tolosa-Hunt syndrome (THS), transverse myelitis, type 1 diabetes, ulcerative colitis (UC), undifferentiated connective tissue disease (UCTD), uveitis, vasculitis, vitiligo, or Wegener's granulomatosis (Granulomatosis with Polyangiitis (GPA)).

In an embodiment, the disorder that can be treated or prevented by the IL-2 agents described herein is lupus nephritis. In an embodiment, the disorder that can be treated or prevented by the IL-2 agents described herein is autoimmune hepatitis. In an embodiment, the disorder that can be treated or prevented by the IL-2 agents described herein is nephrotic syndrome.

Exemplary disorders or conditions that can be treated or prevented by the IL-2 agents described herein include, but are not limited to, a cancer (e.g., a solid tumor or a hematologic cancer), an infectious disease (e.g., a bacterial infection or a viral infection), an immune disorder (e.g., an autoimmune disorder), or an organ transplant rejection (e.g., graft-versus-host disease (GvHD)). In an embodiment, the disorder is a chronic disorder.

Exemplary cancers that can be treated or prevented by the IL-2 agents described herein include, but are not limited to, acute lymphoblastic leukemia (ALL), acute myeloid leukemia (AML), adrenocortical carcinoma, Kaposi sarcoma, an AIDS-related lymphoma, primary central nervous system (CNS) lymphoma, anal cancer, appendix cancer, astrocytoma, atypical teratoid/rhabdoid tumor, basal cell carcinoma, bile duct cancer, bladder cancer, bone cancer (e.g., Ewing sarcoma or osteosarcoma and malignant fibrous histiocytoma), brain tumor (e.g., astrocytomas, brain stem glioma, central nervous system atypical teratoid/rhabdoid tumor, central nervous system embryonal tumor, central nervous system germ cell tumor, craniopharyngioma, or ependymoma), breast cancer, bronchial tumor, Burkitt lymphoma, carcinoid tumor (e.g., gastrointestinal carcinoid tumor), cardiac (heart) tumor, embryonal tumor, germ cell tumor, lymphoma, cervical cancer, cholangiocarcinoma, chordoma, chronic lymphocytic leukemia (CLL), chronic myelogenous leukemia (CML), chronic myeloproliferative neoplasm, colon cancer, colorectal cancer, craniopharyngioma, cutaneous T-cell lymphoma, ductal carcinoma in situ (DCIS), endometrial cancer, ependymoma, esophageal cancer, esthesioneuroblastoma, Ewing sarcoma, extracranial germ cell tumor, extragonadal germ cell tumor, eye cancer (e.g., intraocular melanoma or retinoblastoma), fallopian tube cancer, fibrous histiocytoma of bone, osteosarcoma, gallbladder cancer, gastric (stomach) cancer, gastrointestinal carcinoid tumor, gastrointestinal stromal tumors (GIST), germ cell tumor (e.g., central nervous system tumor, extracranial tumor, extragonadal tumor, ovarian cancer, or testicular cancer), gestational trophoblastic disease, glioma, hairy cell leukemia, head and neck cancer, hepatocellular (liver) cancer, Hodgkin lymphoma, hypopharyngeal cancer, intraocular melanoma, islet cell tumor, pancreatic neuroendocrine tumor, Kaposi sarcoma, kidney cancer (e.g., renal cell cancer or Wilms tumor), Langerhans cell histiocytosis (LCH), laryngeal cancer, leukemia (e.g., acute lymphoblastic leukemia (ALL), acute myeloid leukemia (AML), chronic lymphocytic leukemia (CLL), chronic myelogenous leukemia (CML), or hairy cell leukemia), lip and oral cavity cancer, liver cancer, lung cancer (e.g., non-small cell lung cancer (NSCLC) or small cell lung cancer), lymphoma (e.g., aids-related, Burkitt lymphoma, cutaneous T-cell lymphoma, Hodgkin lymphoma, non-Hodgkin lymphoma, or primary central nervous system (CNS) lymphoma), Waldenström macroglobulinemia, male breast cancer, malignant fibrous histiocytoma of bone and osteosarcoma, melanoma (e.g., intraocular (eye) melanoma), Merkel cell carcinoma, mesothelioma, metastatic squamous neck cancer, midline tract carcinoma, mouth cancer, multiple endocrine neoplasia syndrome, multiple myeloma/plasma cell neoplasm, mycosis fungoides, myelodysplastic syndrome, myelodysplastic/myeloproliferative neoplasm, chronic myeloproliferative neoplasm, nasal cavity and paranasal sinus cancer, nasopharyngeal cancer, neuroblastoma, oral cancer, lip and oral cavity cancer, oropharyngeal cancer, osteosarcoma and malignant fibrous histiocytoma of bone, ovarian cancer (e.g., epithelial ovarian cancer or germ cell ovarian tumor), pancreatic cancer, pancreatic neuroendocrine tumors (islet cell tumors), papillomatosis, paraganglioma, paranasal sinus and nasal cavity cancer, parathyroid cancer, penile cancer, pharyngeal cancer, pheochromocytoma, pituitary tumor, pleuropulmonary blastoma, peritoneal cancer, prostate cancer, rectal cancer, retinoblastoma, rhabdomyosarcoma, salivary gland cancer, sarcoma (e.g., Ewing sarcoma, Kaposi sarcoma, osteosarcoma, rhabdomyosarcoma, soft tissue sarcoma, or uterine sarcoma), Sezary syndrome, skin cancer (e.g., melanoma, Merkel cell carcinoma, or nonmelanoma skin cancer), small intestine cancer, squamous cell carcinoma, testicular cancer, throat cancer, thymoma and thymic carcinoma, thyroid cancer, transitional cell cancer of the renal pelvis and ureter, urethral cancer, endometrial uterine cancer, vaginal cancer, vulvar cancer, or a metastatic lesion thereof.

Exemplary infectious diseases that can be treated or prevented by the IL-2 agents described herein include, but are not limited to, *Acinetobacter* infections, actinomycosis, African sleeping sickness (African trypanosomiasis), AIDS (acquired immunodeficiency syndrome), amebiasis, anaplasmosis, angiostrongyliasis, anisakiasis, anthrax, arcanobacterium haemolyticum infection, argentine hemorrhagic fever, ascariasis, aspergillosis, astrovirus infection, babesiosis, *Bacillus cereus* infection, bacterial pneumonia, bacterial vaginosis, bacteroides infection, balantidiasis, bartonellosis, baylisascaris infection, bk virus infection, black piedra, blastocystosis, blastomycosis, bolivian hemorrhagic fever, botulism (and infant botulism), brazilian hemorrhagic fever, brucellosis, bubonic plague, burkholderia infection, buruli ulcer, calicivirus infection (norovirus and sapovirus), campylobacteriosis, candidiasis (moniliasis; thrush), capillariasis, carrion's disease, cat-scratch disease, cellulitis, chagas disease (american trypanosomiasis), chancroid, chickenpox, chikungunya, chlamydia, chlamydophila pneumoniae infection (taiwan acute respiratory agent or twar), cholera, chromoblastomycosis, chytridiomycosis, clonorchiasis, *Clostridium difficile* colitis, coccidioidomycosis, colorado tick fever (CTF), common cold (Acute viral rhinopharyngitis; Acute coryza), Creutzfeldt-Jakob disease (CJD), Crimean-Congo hemorrhagic fever (CCHF), cryptococcosis, cryptosporidiosis, cutaneous larva migrans (CLM), cyclosporiasis, cysticercosis, cytomegalovirus infection, dengue fever, desmodesmus infection, dientamoebiasis, diphtheria, diphyllobothriasis, dracunculiasis, ebola hemorrhagic fever, echinococcosis, ehrlichiosis, enterobiasis (pinworm infection), enterococcus infection, enterovirus infection, epidemic typhus, erythema infectiosum (fifth disease), exanthem subitum (sixth disease), fasciolasis, fasciolopsiasis, fatal familial insomnia (FFI), filariasis, food poisoning by *Clostridium perfringens*, free-living amebic infection, fusobacterium infection, gas gangrene (clostridial myonecrosis), geotrichosis, gerstmann-straussler-scheinker syndrome (GSS), giardiasis, glanders, gnathostomiasis, gonorrhea, granuloma inguinale (donovanosis), Group A streptococcal infection, Group B streptococcal infection, *haemophilus* influenzae infection, hand, foot and mouth disease (HFMD), Hantavirus Pulmonary Syndrome (HPS), heartland virus disease, *Helicobacter pylori* infection, hemolytic-uremic syndrome (HUS), hemorrhagic fever with renal syndrome (HFRS), hepatitis A, hepatitis B, hepatitis C, hepatitis D, hepatitis E, herpes simplex, histoplasmosis, hookworm infection, human bocavirus infection, human ewingii ehrlichiosis, human granulocytic anaplasmosis (HGA), human metapneumovirus infection, Human monocytic ehrlichiosis, human papillomavirus (HPV) infection, Human parainfluenza virus infection, Hymenolepiasis, Epstein-Barr Virus Infectious Mononucleosis (Mono), influenza (flu), isosporiasis, kawasaki disease, keratitis, kingella kingae infection, kuru, lassa fever, legionellosis (legionnaires' disease), legionellosis (pontiac fever), leishmaniasis, leprosy, leptospirosis, listeriosis, lyme disease (lyme borreliosis), lymphatic filariasis (Elephantiasis), Lymphocytic choriomeningitis, Malaria, Marburg hemorrhagic fever (MHF), Measles, Middle East respiratory syndrome (MERS), melioidosis (Whitmore's disease), meningitis, meningococcal disease, metagonimiasis, microsporidiosis, molluscum contagiosum (MC), Monkeypox, Mumps, Murine typhus (Endemic typhus), *Mycoplasma* pneumonia, Mycetoma (disambiguation), Myiasis, Neonatal conjunctivitis (Ophthalmia neonatorum), (New) Variant Creutzfeldt-Jakob disease (vCJD, nvCJD), nocardiosis, onchocerciasis (River blindness), opisthorchiasis, paracoccidioidomycosis (South American blastomycosis), paragonimiasis, pasteurellosis, pediculosis capitis (head lice), pediculosis corporis (body lice), pediculosis pubis (pubic lice, crab lice), pelvic inflammatory disease (PID), pertussis (Whooping cough), plague, pneumococcal infection, pneumocystis pneumonia (PCP), pneumonia, poliomyelitis, prevotella infection, primary amoebic meningoencephalitis (PAM), progressive multifocal leukoencephalopathy, psittacosis, Q fever, rabies, relapsing fever, respiratory syncytial virus infection, rhinosporidiosis, rhinovirus infection, rickettsial infection, rickettsialpox, Rift Valley fever (RVF), Rocky Mountain spotted fever (RMSF), rotavirus infection, rubella, salmonellosis, SARS (Severe Acute Respiratory Syndrome), scabies, schistosomiasis, sepsis, shigellosis (Bacillary dysentery), shingles (Herpes zoster), smallpox (Variola), sporotrichosis, staphylococcal food poisoning, staphylococcal infection, strongyloidiasis, subacute sclerosing panencephalitis, syphilis, Taeniasis, Tetanus (Lockjaw), Tinea barbae (Barber's itch), Tinea capitis (Ringworm of the Scalp), Tinea corporis (Ringworm of the Body), Tinea cruris (Jock itch), Tinea manum (Ringworm of the Hand), Tinea nigra, Tinea pedis (Athlete's foot), Tinea unguium (Onychomycosis), Tinea *versicolor* (*Pityriasis versicolor*), Toxocariasis (Ocular Larva Migrans (OLM)), Toxocariasis (Visceral Larva Migrans (VLM)), Trachoma, Toxoplasmosis, Trichinosis, Trichomoniasis, Trichuriasis (Whipworm infection), Tuberculosis, Tularemia, Typhoid fever, Typhus fever, *Ureaplasma urealyticum* infection, Valley fever, Venezuelan equine encephalitis, Venezuelan hemorrhagic fever, *Vibrio vulnificus* infection, *Vibrio parahaemolyticus* enteritis, viral pneumonia, West Nile Fever, white *piedra* (Tinea blanca), *Yersinia pseudotuberculosis* infection, yersiniosis, yellow fever, Zika fever, or zygomycosis.

The IL-2 agents described herein are typically administered at a frequency that keeps a therapeutically effective level of IL-2 agents in the patient's system until the patient recovers. For example, the IL-2 agents may be administered at a frequency that achieves a serum concentration sufficient for at least about 1, 2, 5, 10, 20, 30, or 40 agents to bind each target molecule or cell. In an embodiment, the IL-2 agent is administered every 1, 2, 3, 4, 5, 6, or 7 days, every 1, 2, 3, 4, 5, or 6 weeks, or every 1, 2, 3, 4, 5, or 6 months. In an embodiment, the IL-2 agent is administered once a month. In an embodiment, the IL-2 agent is administered once a week.

Methods of administering various agents (e.g., antibody molecules or fusion proteins) are known in the art and are described below. Suitable dosages of the agents used will depend on the age and weight of the subject and the particular drug used.

In an embodiment, the ratio of regulatory T cells (Tregs) to non-regulatory T cells within the subject (e.g., in the peripheral blood of the subject) increases after the administration. In an embodiment, the ratio of regulatory T cells (Tregs) to non-regulatory T cells within the subject (e.g., in the peripheral blood of the subject) remains essentially the same after the administration.

The IL-2 agents can be used by themselves or conjugated to a second agent, e.g., a protein, e.g., an antibody molecule, a polymer (e.g., polyethylene glycol (PEG)), or a cytokine. In an embodiment, the second agent comprises a second IL-2 agent. This method includes: administering the IL-2 agent, alone or conjugated to a second agent, to a subject requiring such treatment.

Lupus Nephritis

The IL-2 agents (e.g., e.g., IL-2 variants, IL-2 fusion proteins (e.g., IL-2-Fc fusion proteins), IL-2 complexes, or IL-2 conjugates) described herein, as well as the pharmaceutical compositions disclosed herein, can be used to treat lupus nephritis. Lupus nephritis is an autoimmune disorder that is a form of glomerulonephritis that can constitute the most severe organ manifestation of systemic lupus erythematosus (SLE). Lupus nephritis leads to autoantibodies in the kidney, e.g., antibodies to nucleic acid containing particles (anti-nuclear antibodies (ANA)), which causes inflammation, e.g., inflammation in the nephrons, and impairs kidney function, e.g., waste removal and filtration. It can result in permanent scarring and damage to the kidneys and possibly end-stage renal disease (ESRD). Lupus nephritis often develops in a subject within five years of developing lupus. In an embodiment, lupus, e.g., SLE and/or lupus nephritis, can result from a combination of factors, e.g., genetic, environmental, immunoregulatory, hormonal, and/or epigenetic factors.

Imbalance of T cells due to IL-2 deprivation can amplify murine lupus and IL-2 can restore Treg:Tcon balance and impede disease progression. Adoptive transfer of ex vivo expanded regulatory T cells can suppress disease in lupus-prone mice. Lower number of Tregs are typically associated with patients with active SLE and Tregs can decline during flare and increase during remission.

There is unmet need for better treatment in lupus nephritis. For example, conventional immunosuppressive treatments are not uniformly effective. Even in patients who respond, 35% may relapse. 5-20% of patients with lupus nephritis develop End-stage kidney disease (ESKD) within 10 years from the initial event. Drug-induced toxicity remains a concern, one of the commonest cause of mortality and morbidity is infections Exemplary symptoms of lupus nephritis include, but are not limited to, blood in the urine (hematuria), proteinuria, foamy urine (e.g., foamy urine due to excess protein in the urine), increased urination, edema, Reynaud syndrome, joint pain, pericarditis and effusion, arthritis, pleural effusion, high blood pressure, swelling in hands, ankles, and feet, excess levels of creatine in the blood, muscle pain, weight gain, fever of unknown etiology, neurological complications, and a red rash that is typically localized to the face (e.g., across the nose and face).

Diagnosis of lupus nephritis can be based on urinalysis and the measurement of blood, cell casts (e.g., cell fragments often found in the blood and/or the tubules of the kidneys), and protein levels in the urine. Diagnosis can also be based on a blood test to estimate kidney function, e.g., a creatine blood test with or without a blood urea nitrogen (BUN) test. Additionally, to test kidney function, the person's estimated glomerular filtration rate (eGFR) can be measured from a blood sample. A kidney biopsy can also be performed, which can be used to stage lupus nephritis. In an embodiment, lupus nephritis is classified as one of six stages under the International Society of Nephrology/Renal Pathology Society (ISN/RPS) classification system, which include, minimal mesangial lupus nephritis (Class I), mesangial proliferative lupus nephritis (Class II), focal lupus nephritis (<50% of all glomeruli) (Class III), diffuse segmental or global lupus nephritis (>50% of all glomeruli)

(Class IV), membranous lupus nephritis (Class V), or advanced sclerosing lupus nephritis (>90% of all glomeruli) (Class VI).

In an embodiment, an IL-2 agent described herein is used in combination with a different therapeutic agent or modality for treating lupus nephritis in a subject.

Autoimmune Hepatitis

The IL-2 agents (e.g., e.g., IL-2 variants, IL-2 fusion proteins (e.g., IL-2-Fc fusion proteins), IL-2 complexes, or IL-2 conjugates) described herein, as well as the pharmaceutical compositions disclosed herein, can be used to treat autoimmune hepatitis. Autoimmune hepatitis is an autoimmune disorder that affects the liver, resulting in progressive and chronic inflammation as well as liver damage. It can result in permanent scarring and cirrhosis of the liver and/or liver failure. In an embodiment, autoimmune hepatitis can be characterized by a T cell-mediated immune response against liver autoantigens that results from a loss of regulatory immune control and tolerance. In an embodiment, autoimmune hepatitis can result from a from a combination of factors, e.g., genetic, environmental, dietary, and immunoregulatory factors. In an embodiment, autoimmune hepatitis can result from an unknown etiology.

Hepatic inflammation typically depends on the balance between T effector cells and Tregs. Biopsy is required for diagnosis and modulation of treatment and interface hepatitis is often the hallmark finding in biopsy. AIH patients can have lower IL-2 levels and Tregs respond well to IL-2 supplement. Without wishing to be bound by theory, it is believed that in an embodiment, T cells (both Tregs and T effector cells) play a role in the development and persistence of AIH. For example, impaired Treg function and the ratio of Tregs to T effector cells in inflamed liver tissue may serve as potential drivers of disease.

There is unmet need for better treatment in autoimmune hepatitis. Steroid based therapies are considered to be the standard of care. Relapse after treatment cessation is almost universal (e.g., between 25% and 100%). Chronic azathioprine use can be associated with risk of cancer.

Exemplary symptoms of autoimmune hepatitis include, but are not limited to, joint pain, lethargy, nausea, poor appetite, pain over the liver in the upper abdomen, jaundice of the eyes and skin, dark colored urine, rash, psoriasis, vitiligo, acne, fatigue, spider angiomas, hepatomegaly, rectal bleeding or vomiting, unexplained weight loss, pruritis, edema of lower legs, ankles, or feet, and bloating from a buildup of fluid in the abdomen. In an embodiment, autoimmune hepatitis results in increased levels of the serum transaminase, IgG levels, autoantibodies, liver interface hepatitis, and/or liver enzymes, alanine transaminase (ALT) and an aspartate transaminase (AST). In an embodiment, autoimmune hepatitis results in decreased levels of IL-2.

Diagnosis of autoimmune hepatitis can be based on a laboratory test and/or liver function test, e.g., a blood test, a liver biopsy, an ultrasound, a Doppler ultrasonography, a CT and/or an MRI and cholangiography (x-rays of the bile ducts). In an embodiment, the blood test include one or more of a coagulation test (e.g., to measure clotting factors), a complete blood count (CBC), an electrolyte panel, a serum bilirubin test, a serum albumin test, a serum alkaline phosphatase test, a serum aminotransferases (transaminases) test, a prothrombin time (PTT) test, an alanine transaminase (ALT) test, an aspartate transaminase (AST) test, gamma-glutamyl transpeptidase test, a lactic dehydrogenase test, a 5-nucleotidase test, an alpha-fetoprotein test, and a mitochondrial antibodies test. In an embodiment, diagnosis of autoimmune hepatitis includes a measure of autoimmune antibodies, e.g., antinuclear antibodies (ANA) and anti-smooth muscle antibodies (SMA).

In an embodiment, diagnosis of autoimmune hepatitis comprises quantifying a Revised Diagnostic Criteria (RDC) score. In an embodiment, quantification of an RDC score comprises one or more of the following criteria: gender (e.g., being a female); ratio of alkaline phosphatase levels to aspartate aminotransferase or alanine aminotransferase levels; γ-globulin or IgG levels; ANA, SNA and anti-liver kidney microsomal type I (anti-LKM1) antibody titers, anti-mitochondrial antibody positivity, viral serological markers, use of drugs with hepatoxic potential, alcohol use, HLADR3 or HLADR4 genotypes, concurrent immunological diseases (e.g., thyroiditis and/or colitis), and/or histological features (e.g., presence or absence of interface hepatitis, plasma cells, rosettes, and/or biliary changes). In an embodiment, an aggregate RDC score of >15 points is classified as autoimmune hepatitis. In an embodiment, an aggregate RDC score of 10-15 is classified as probable autoimmune hepatitis.

In an embodiment, diagnosis of autoimmune hepatitis comprises quantifying a Simplified Diagnostic Criteria (SDC) score. In an embodiment, an SDC aggregate score of >7 is classified as autoimmune hepatitis. In an embodiment, an SDC aggregate score of >6 is classified as probable autoimmune hepatitis. In an embodiment, quantification of an SDC score comprises one or more of the following criteria: presence of autoantibodies (e.g., ANA, SNA and/or anti-LKM1 antibodies), immunoglobulin levels (e.g., levels of γ-globulin or IgG), viral hepatitis, and/or histological features compatible with autoimmune hepatitis.

In an embodiment, autoimmune hepatitis can be classified as Type I autoimmune hepatitis. Type I autoimmune hepatitis can occur at an any age. In an embodiment, Type I autoimmune hepatitis can often be associated with other autoimmune disorders, e.g., thyroiditis, inflammatory bowel disease, type I diabetes, Addison's disease. In an embodiment, autoimmune hepatitis can be classified as Type II autoimmune hepatitis. Type II autoimmune hepatitis can be more common in children and younger adults. In an embodiment, Type II autoimmune hepatitis may be associated with other autoimmune disorders, thyroiditis, inflammatory bowel disease, type I diabetes, Addison's disease.

In an embodiment, an IL-2 agent described herein is used in combination with a different therapeutic agent or modality for treating autoimmune hepatitis in a subject.

Nephrotic Syndrome

The IL-2 agents (e.g., e.g., IL-2 variants, IL-2 fusion proteins (e.g., IL-2-Fc fusion proteins), IL-2 complexes, or IL-2 conjugates) described herein, as well as the pharmaceutical compositions disclosed herein, can be used to treat nephrotic syndrome, e.g., an idiopathic nephrotic syndrome. Nephrotic syndrome is a collection of symptoms that indicate kidney damage, which include but are not limited to, albuminuria (increased protein in the urine), hyperlipidemia (higher than normal fat and cholesterol levels in the blood), edema (e.g., usually in the legs, feet, ankles and less often in the hands or face), and/or hypoalbuminemia (low levels of albumin in the blood). In an embodiment, nephrotic syndrome results from damage to the glomeruli of the kidneys, which impairs kidney function, e.g., waste removal and filtration. In an embodiment, in nephrotic syndrome, the damaged glomeruli allow at least about 3 grams or more of protein to leak into the urine, as measured over a 24-hour period. In an embodiment, nephrotic syndrome can lead to other health problems, e.g., anemia, heart disease, high blood pressure, fluid buildup, blood clots, infections, malnutrition, stroke, heart attack, acute kidney injury, chronic kidney disease, kidney failure, and/or end-stage renal disease (ESRD).

In an embodiment, nephrotic syndrome results from systemic T-cell dysregulation, e.g., a reduction of CD4+ T helper cells and increased prevalence of CD8+ cytotoxic T cells; imbalance between Th2 and Th1 cells with increased production of IL-13, and/or reduced frequency and/or function of T regulatory cells.

In an embodiment, nephrotic syndrome is the result of other diseases that affect the kidneys, e.g., focal segmental glomerulosclerosis (FSGS), minimal change disease (MCD), IgA nephropathy, lupus nephritis, and membranous nephropathy. In an embodiment, nephrotic syndrome is the result of systemic diseases that affect the whole body including but not limited to the kidneys, e.g., diabetes, amyloidosis, and/or lupus (e.g., systemic lupus erythematosus (SLE) and/or lupus nephritis). In an embodiment, idiopathic neuropathy results from MCD or Primary FSGS. In an embodiment, focal segmental glomerulosclerosis (FSGS) is the most common etiology of idiopathic nephrotic syndrome in adults. In an embodiment, minimal change disease (MCD) is the most common etiology of idiopathic nephrotic syndrome in children. In an embodiment, MCD results in decreased levels of T regulatory cells, T regulatory cell-related cytokines (e.g., TGF-β1 and IL-10), and T regulatory cell-related transcription factors (e.g., FOXP3). In an embodiment, increasing the number of T regulatory cells can induce remission of FSGS.

Exemplary symptoms of nephrotic syndrome include, but are not limited to, edema, foamy urine (e.g., foamy urine due to excess protein in the urine), weigh gain (e.g., weight gain due to excessive fluid retention), fatigue, and loss of appetite.

Diagnosis of nephrotic syndrome can be based on urinalysis and the measurement of blood, cell casts (e.g., cell fragments often found in the blood and/or the tubules of the kidneys), albumin and/or creatine levels in the urine, and protein levels in the urine. Diagnosis can also be based on a blood test to estimate kidney function, e.g., a creatine blood test with or without a blood urea nitrogen (BUN) test. Additionally, to test kidney function, the person's estimated glomerular filtration rate (eGFR) can be measured from a blood sample. A kidney biopsy can also be performed.

Nephrotic syndrome can typically be treated by steroids, but relapse is common and often requires use of one or more additional therapies.

In an embodiment, an IL-2 agent described herein is used in combination with a different therapeutic agent or modality for treating nephrotic syndrome in a subject.

Combination Therapies

The IL-2 agents (e.g., e.g., IL-2 variants, IL-2 fusion proteins, IL-2 complexes, or IL-2 conjugates) described herein, as well as the pharmaceutical compositions disclosed herein, can be used in combination with other therapies.

For example, the combination therapy can include an IL-2 agent described herein co-formulated with, and/or co-administered with, one or more additional therapeutic agents, e.g., one or more additional therapeutic agents described herein. In other embodiments, the IL-2 agents are administered in combination with other therapeutic treatment modalities, e.g., other therapeutic treatment modalities described herein. Such combination therapies may advantageously utilize lower dosages of the administered therapeutic agents, thus avoiding possible toxicities or complications associated with the various monotherapies.

Administered "in combination," as used herein, means that two (or more) different treatments are delivered to the subject before, or during the course of the subject's affliction with a disorder. In an embodiment, two or more treatments are delivered prophylactically, e.g., before the subject has the disorder or is diagnosed with the disorder. In another embodiment, the two or more treatments are delivered after the subject has developed or diagnosed with the disorder. In an embodiment, the delivery of one treatment is still occurring when the delivery of the second begins, so that there is overlap. This is sometimes referred to herein as "simultaneous" or "concurrent delivery." In other embodiments, the delivery of one treatment ends before the delivery of the other treatment begins. In an embodiment of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In an embodiment, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

In an embodiment, the IL-2 agent is administered in combination with a second therapy (e.g., an additional agent) to treat or prevent a disorder described herein. In an embodiment, the additional agent is a second IL-2 agent, e.g., an IL-2 agent different from a first IL-2 agent. Exemplary IL-2 agents that can be used in combination include, but are not limited to, any combination of the IL-2 agents described herein. In another embodiment, the additional agent is other than an IL-2 agent. For example, the additional agent can be a small molecule or a nucleic acid molecule. In yet another embodiment, the second therapy is chosen from a surgery, a radiation therapy, a cell therapy (e.g., a stem cell therapy), or an organ or tissue transplantation.

In an embodiment, the second therapy comprises a therapy chosen from one or more of: an androgen replacement therapy, an antihormone therapy, an antiserum therapy, an autologous immune enhancement therapy, a biotherapy, a blood irradiation therapy, a brachytherapy, a cardiac resynchronization therapy, a cell therapy, a cell transfer therapy, a chelation therapy, a chemotherapy, a chrysotherapy, a cobalt therapy, a cold compression therapy, a cryotherapy, an electroconvulsive therapy, an electromagnetic therapy, an electron therapy, an electrotherapy, an enzyme replacement therapy, an epigenetic therapy, an estrogen replacement therapy, an extracorporeal shockwave therapy, a fast neutron therapy, a fluoride therapy, a gene therapy, a heat therapy, a helminthic therapy, a hormone therapy, a hormone replacement therapy, a host modulatory therapy, a hyperbaric oxygen therapy, a hyperthermia therapy, an immunosuppressive therapy, an immunotherapy, an intraoperative electron radiation therapy, an intraoperative radiation therapy, an inversion therapy, a laser therapy, a light therapy, a lithium therapy, a low level laser therapy, a magnet therapy, a magnetic resonance therapy, a medical gas therapy, a medical nutrition therapy, a molecular chaperone therapy, a molecular therapy, a monoclonal antibody therapy, a negative air ionization therapy, a neutron capture therapy, a neutron therapy, an oral rehydration therapy, an osmotherapy, an oxygen therapy, an ozone therapy, a palliative therapy, a particle therapy, a phage therapy, a phonemic neurological hypochromium therapy, a photodynamic therapy, a phototherapy, a photothermal therapy, a physical therapy, a prolotherapy, a protein therapy, a proton therapy, a pulsed electromagnetic field therapy, a PUVA therapy, a radiation therapy, a rehydration therapy, a respiratory therapy, salvage therapy, a serotherapy, a stem cell therapy, a stereotactic radiation therapy, a targeted therapy, a thermotherapy, a TK cell therapy, a tolerogenic therapy, a transdermal continuous oxygen therapy, an ultraviolet light therapy, or a virotherapy.

Exemplary therapies that can be used in combination with an IL-2 agent described herein to treat or prevent other disorders are also described in the section of "Methods of Treating or Preventing Disorders" herein.

The present disclosure also includes any of the following numbered paragraphs:

1. An interleukin-2 (IL-2) agent comprising a human IL-2 variant comprising an amino acid alteration (e.g., substitution) at one or more position(s) chosen from: T3, H16, I28, K35, R38, F42, E68, V69, Q74, D84, S87, N88, I92, C125, Q126, or a combination thereof.
2. The IL-2 agent of paragraph 1, comprising an amino acid alteration (e.g., substitution) at position V69, Q74, or a combination thereof.
3. The IL-2 agent of paragraph 1 or 2, comprising an amino acid alteration (e.g., substitution) at positions V69 and Q74.
4. The IL-2 agent of any one of paragraphs 1-3, wherein the amino acid substitution is V69A.
5. The IL-2 agent of any one of paragraphs 1-4, wherein the amino acid substitution is Q74P.
6. The IL-2 agent of any one of paragraphs 1-5, comprising an amino acid alteration (e.g., substitution) at position H16, I92, D84, or a combination thereof.
7. The IL-2 agent of any one of paragraphs 1-6, comprising an amino acid alteration (e.g., substitution) at position H16, optionally wherein the amino acid substitution is H16N, H16L, or H16D.
8. The IL-2 agent of paragraph 7, wherein the amino acid substitution is H16N.
9. The IL-2 agent of paragraph 7, wherein the amino acid substitution is H16L.
10. The IL-2 agent of any one of paragraphs 1-9, comprising an amino acid alteration (e.g., substitution) at position at I92, optionally wherein the amino acid substitution is I92S.
11. The IL-2 agent of any one of paragraphs 1-10, comprising an amino acid alteration (e.g., substitution) at position D84, optionally wherein the amino acid substitution is D84V.
12. The IL-2 agent of any one of paragraphs 1-11, comprising an amino acid alteration (e.g., substitution at position K35, R38, F42, E68, or a combination thereof.
13. The IL-2 agent of any one of paragraphs 1-12, comprising an amino acid alteration (e.g., substitution) at position K35, optionally wherein the amino acid substitution is K35E.
14. The IL-2 agent of any one of paragraphs 1-13, comprising an amino acid alteration (e.g., substitution) at position R38, optionally wherein the amino acid substitution is R38E, R38N or R38Q.
15. The IL-2 agent of paragraph 14, wherein the amino acid substitution is R38N.
16. The IL-2 agent of paragraph 15, wherein the amino acid substitution is R38Q.
17. The IL-2 agent of any one of paragraphs 1-16, comprising an amino acid alteration (e.g., substitution) at position F42, optionally wherein the amino acid substitution is F42K or F42Q.
18. The IL-2 agent of paragraph 17, wherein the amino acid substitution is F42Q.
19. The IL-2 agent of paragraph 1, comprising an amino acid alteration (e.g., substitution):
    (i) at position V69 and Q74, and/or at position K35; and
    (ii) at position H16, I92, or D84; and optionally
    (iii) at position R38, F42, E68, or a combination thereof.
20. The IL-2 agent of paragraph 1, comprising an amino acid alteration (e.g., substitution):
    (i) at position V69 and Q74, and/or at position K35; and
    (ii) at position H16, I92, or D84; and
    (iii) at position R38, F42, E68, or a combination thereof.
21. The IL-2 agent of paragraph 1, comprising an amino acid alteration (e.g., substitution):
    (i) at position V69 and Q74, and/or at position K35; and
    (ii) at position H16, I92, or D84; or
    (iii) at position R38, F42, E68, or a combination thereof.
22. The IL-2 agent of paragraph 1, comprising an amino acid alteration (e.g., substitution):
    (i) at position V69 and Q74; and/or at position K35; and
    (ii) at position H16, I92, D84, or a combination thereof, and
    (iii) at position R38, F42, E68, or a combination thereof.
23. The IL-2 agent of any one of paragraphs 19-22, comprising an amino acid alteration (e.g., substitution) at position V69, Q74, and H16, optionally wherein the amino acid substitution is V69A, Q74P, and H16N or H16L, respectively, optionally wherein the amino acid substitutions are V69A, Q74P, and H16L.
24. The IL-2 agent of any one of paragraphs 19-22, comprising an amino acid alteration (e.g., substitution) at position V69, Q74, and I92, optionally wherein the amino acid substitution is V69A, Q74P, and I92S, respectively.
25. The IL-2 agent of any one of paragraphs 19-22, comprising an amino acid alteration (e.g., substitution) at position V69, Q74, and D84, optionally wherein the amino acid substitution is V69A, Q74P, and D84V, respectively.
26. The IL-2 agent of paragraph 21, comprising an amino acid alteration (e.g., substitution) at position V69, Q74, and R38, optionally wherein the amino acid substitution is V69A, Q74P, and R38Q, respectively.
27. The IL-2 agent of paragraph 21, comprising an amino acid alteration (e.g., substitution) at position V69, Q74, and F42, optionally wherein the amino acid substitution is V69A, Q74P, and F42Q, respectively.
28. The IL-2 agent of paragraph 21, comprising an amino acid alteration (e.g., substitution) at position V69, Q74, and R38, optionally wherein the amino acid substitution is V69A, Q74P, and R38N, respectively.
29. The IL-2 agent of paragraph 21, comprising an amino acid alteration (e.g., substitution) at position V69, Q74, and R38, optionally wherein the amino acid substitution is V69A, Q74P, and R38E, respectively.
30. The IL-2 agent of any one of paragraphs 19-22, comprising an amino acid alteration (e.g., substitution) at position V69, Q74, K35, and H16, optionally wherein the amino acid substitution is V69A, Q74P, K35E, and H16N or H16L, respectively.
31. The IL-2 agent of paragraph 30, wherein the amino acid substitution is V69A, Q74P, K35E, and H16N.
32. The IL-2 agent of paragraph 30, wherein the amino acid substitution is V69A, Q74P, K35E, and H16L.

33. The IL-2 agent of any one of paragraphs 19, 20, or 22, comprising an amino acid alteration (e.g., substitution) at position V69, Q74, K35, H16, and R38, optionally wherein the amino acid substitution is V69A, Q74P, K35E, H16N, and R38N, respectively.

34. The IL-2 agent of any one of paragraphs 19, 20, or 22, comprising an amino acid alteration (e.g., substitution) at position V69, Q74, H16, and R38, optionally wherein the amino acid substitution is V69A, Q74P, H16N or H16L, and R38N or R38Q, respectively, optionally wherein the amino acid substitutions are V69A, Q74P, H16N or H16L, and R38Q.

35. The IL-2 agent of paragraph 34, wherein the amino acid substitutions are V69A, Q74P, H16L, and R38Q.

36. The IL-2 agent of any one of paragraphs 1-35, comprising an amino acid alteration (e.g., substitution) at position 128, E68, S87, N88, Q126, or a combination thereof.

37. The IL-2 agent of any one of paragraphs 1-36, comprising an amino acid alteration (e.g., substitution) at position 128, optionally wherein the amino acid substitution is I28T or I28F.

38. The IL-2 agent of any one of paragraphs 1-37, comprising an amino acid alteration (e.g., substitution) at position E68, optionally wherein the amino acid substitution is E68Q or E68N.

39. The IL-2 agent of any one of paragraphs 1-38, comprising an amino acid alteration (e.g., substitution) at position S87, optionally wherein the amino acid substitution is S87R.

40. The IL-2 agent of any one of paragraphs 1-39, comprising an amino acid alteration (e.g., substitution) at position N88, optionally wherein the amino acid substitution is N88S, N88L, or N88D.

41. The IL-2 agent of any one of paragraphs 1-40, comprising an amino acid alteration (e.g., substitution) at position Q126, optionally wherein the amino acid substitution is Q126T, Q126K, or Q126R.

42. The IL-2 agent of any one of paragraphs 1-41, comprising an amino acid alteration (e.g., substitution) at positions C125.

43. The IL-2 agent of paragraph 42, wherein the amino acid substitution is C125S.

44. The IL-2 agent of any one of paragraphs 1-43, comprising an amino acid alteration (e.g., substitution) at position T3.

45. The IL-2 agent of paragraph 44, wherein the amino acid substitution is T3A.

46. The IL-2 agent of any one of paragraphs 1-45, comprising an amino acid alteration (e.g., substitution) at positions V69, Q74, and C125, optionally wherein the amino acid substitution is V69A, Q74P, and C125S, respectively.

47. The IL-2 agent of paragraph 46, further comprising an amino acid alteration (e.g., substitution) at position T3, H16, 192, or a combination thereof.

48. The IL-2 agent of paragraph 46 or 47, comprising an amino acid alteration (e.g., substitution) at positions H16, V69, Q74, and C125, optionally wherein the amino acid substitution is H16N or H16L, V69A, Q74P, and C125S, respectively.

49. The IL-2 agent of any of paragraphs 46-48, comprising an amino acid alteration (e.g., substitution) at positions H16, V69, Q74, and C125, optionally wherein the amino acid substitution is H16L, V69A, Q74P, and C125S, respectively.

50. The IL-2 agent of paragraph 48 or 49, wherein the amino acid substitution is H16L, V69A, Q74P, and C125S.

51. The IL-2 agent of paragraph 48, wherein the amino acid substitution is H16N, V69A, Q74P, and C125S.

52. The IL-2 agent of any of paragraphs 46-48, comprising an amino acid alteration (e.g., substitution) at positions H16, V69, Q74, 192, and C125, optionally wherein the amino acid substitution is H16L, V69A, Q74P, I92S, and C125S, respectively.

53. The IL-2 agent of paragraph 46 or 47, comprising an amino acid alteration (e.g., substitution) at positions T3, V69, Q74, and C125, optionally wherein the amino acid substitution is T3A, V69A, Q74P, and C125S, respectively.

54. The IL-2 agent of paragraph 53, comprising an amino acid alteration (e.g., substitution) at positions T3, H16, V69, Q74, and C125, optionally wherein the amino acid substitution is T3A, H16N or H16L, V69A, Q74P, and C125S, respectively.

55. The IL-2 agent of paragraph 53, comprising an amino acid alteration (e.g., substitution) at positions T3, V69, Q74, 192, and C125, optionally wherein the amino acid substitution is T3A, H16N, V69A, Q74P, I92S, and C125S, respectively.

56. The IL-2 agent of paragraph 1, wherein the human IL-2 variant comprises an amino acid sequence chosen from: SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, SEQ ID NO: 1002, or a functional fragment thereof, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

57. The IL-2 agent of paragraph 56, wherein the human IL-2 variant comprises the amino acid sequence shown as SEQ ID NO: 4, SEQ ID NO: 5, or a functional fragment thereof, or an amino acid sequence with at least 80%, 85%, 90%, 91%, 92%, 93%, 94%, 95%, 96%, 97%, 98%, 99%, or more sequence identity thereof, or differing by no more than 1, 2, 3, 4, 5, 6, 7, 8, 9, 10, 11, 12, 13, 14, 15, 20, 25, or 30 amino acids thereto.

58. The IL-2 agent of any one of the preceding paragraphs, wherein the human IL-2 variant is fused to a non-IL-2 moiety by a linker, wherein the linker is a polypeptide linker, optionally wherein the polypeptide linker is a flexible linker, a rigid linker, or a cleavable linker.

59. The IL-2 agent of paragraph 58, wherein the polypeptide linker is a Gly-Ser linker (e.g., a $(G_4S)_n$ linker, wherein n=1, 2, 3, 4, 5, 6 or more (SEQ ID NO: 1020)), a proline-rich extended linker (e.g., V1 GPc, V2, GPGc, V3 GcGcP, cellulase linker 4, cellulase linker 4), a rigid linker (e.g., $A(EAAAK)_nA$, wherein n=2, 3, 4, 5, or more (SEQ ID NO: 1021); REPR_12), a non-GS linker (e.g., $(GGGSA)_n$, wherein n=1, 2, 3, 4, 5, or more (SEQ ID NO: 1022)), or an immunoglobulin hinge region or portion thereof.

60. The IL-2 agent of paragraph 58 or 59, wherein the polypeptide linker is a Gly-Ser linker comprising $(G_4S)_1$ (SEQ ID NO: 1023), $(G_4S)_2$ (SEQ ID NO: 1024), $(G_4S)_3$ (SEQ ID NO: 1025), $(G_4S)_4$ (SEQ ID NO: 48), $(G_4S)_5$ (SEQ ID NO: 1026), or $(G_4S)_6$ (SEQ ID NO: 1027).

61. The IL-2 agent of paragraph 60, wherein the polypeptide linker is a Gly-Ser linker comprising (G$_4$S)$_4$ (SEQ ID NO: 48).

62. The IL-2 agent of paragraph 58, wherein the polypeptide linker comprises an amino acid sequence chosen from SEQ ID NO: 48, SEQ ID NO: 49, SEQ ID NO: 50, SEQ ID NO: 51, SEQ ID NO: 52, SEQ ID NO: 53, SEQ ID NO: 54, or SEQ ID NO: 55.

63. The IL-2 agent of paragraph 62, wherein the polypeptide linker comprises the amino acid sequence of SEQ ID NO: 48.

64. The IL-2 agent of any one of paragraphs 58-63, wherein the non-IL-2 moiety is an immunoglobulin Fc region, or a fragment or portion thereof.

65. The IL-2 agent of paragraph 64, wherein the immunoglobulin Fc region comprises an IgG Fc region, an IgD Fc region, an IgA Fc region, an IgM Fc region, or an IgE Fc region, or fragment or portion thereof.

66. The IL-2 agent of paragraph 65, wherein the IgG Fc region comprises a wild type human IgG1 Fc region, a wild type IgG2 Fc region, or a wild type human IgG4 Fc region, or a fragment or portion thereof.

67. The IL-2 agent of paragraph 65, wherein the IgG Fc region comprises a mutant IgG1 (e.g., IgG1 m3 allotype) or mutant IgG4 Fc region, or a fragment or portion thereof.

68. The IL-2 agent of paragraph 67, comprising a mutant IgG4 Fc region, or a fragment or portion thereof, wherein the mutant IgG4 Fc region is human 69. The IL-2 agent of paragraph 67 or 68, wherein the mutant IgG4 Fc region, or fragment or portion thereof, comprises an amino acid alteration (e.g., substitution) at Ser228, numbering according to EU numbering, optionally wherein the amino acid alteration (e.g., substitution) at Ser228 is S228P.

70. The IL-2 agent of any one of paragraphs 67-69, wherein the mutant IgG4 Fc region, or fragment or portion thereof, comprises an amino acid alteration (e.g., substitution) at Arg409, numbering according to EU numbering, optionally wherein the amino acid alteration (e.g., substitution) at Arg409 is R409K.

71. The IL-2 agent of any one of paragraphs 67-70, wherein the mutant IgG4 Fc region, or a fragment or portion thereof, comprises amino acid alterations (e.g., substitutions) at Thr307, Gln311, and Ala378, numbering according to EU numbering, optionally wherein the amino acid alterations (e.g., substitutions) are T307Q, Q311V, and A378V, respectively.

72. The IL-2 agent of paragraph 67 or 68, wherein the mutant IgG4 Fc region comprises an amino acid sequence chosen from SEQ ID NO: 44, SEQ ID NO: 45, SEQ ID NO: 46, or SEQ ID NO: 47.

73. The IL-2 agent of paragraph 67, comprising a mutant IgG1 Fc region, or a fragment or portion thereof, wherein the mutant IgG1 Fc region is human.

74. The IL-2 agent of paragraph 67 or 73, wherein the mutant IgG1 Fc region, or a fragment or portion thereof, comprises an amino acid alteration (e.g., substitution) at Asn297, numbering according to EU numbering, optionally wherein the amino acid alteration (e.g., substitution) at Asn297 is N297G.

75. The IL-2 agent of paragraph 67 or 73, wherein the mutant IgG1 Fc region, or a fragment or portion thereof, comprises amino acid alterations (e.g., substitutions) at Leu234, Leu235, and Pro329, numbering according to EU numbering, optionally wherein the amino acid alterations (e.g., substitutions are L234A, L235A, and P329G, respectively.

76. The IL-2 agent of paragraphs 67 or 73-75, wherein the mutant IgG1 Fc region, or a fragment or portion thereof, comprises amino acid alterations (e.g., substitutions) at Thr307, Gln311, and Ala378, numbering according to EU numbering, optionally wherein the amino acid alterations (e.g., substitutions) are T307Q, Q311V, and A378V, respectively.

77. The IL-2 agent of paragraph 67 or 73, wherein the mutant IgG1 Fc region comprises an amino acid sequence chosen from SEQ ID NO: 40, SEQ ID NO: 41, SEQ ID NO: 42, SEQ ID NO: 43, or SEQ ID: 1003.

78. The IL-2 agent of paragraph 67 or 73, wherein the mutant IgG1 Fc region comprises the amino acid sequence of SEQ ID NO: 1003 or a sequence with at least 95% sequence identity thereto.

79. The IL-2 agent of any one of paragraphs 58-77, wherein the non-IL-2 moiety inhibits or decreases the ability of the IL-2 agent to elicit Fc-receptor-mediated immune effector functions.

80. An interleukin-2 (IL-2) agent comprising an IL-2 variant comprising an amino acid sequence chosen from SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, or SEQ ID NO: 1002, or a functional fragment thereof; wherein the IL-2 agent comprises a Gly-Ser linker, optionally wherein the Gly-Ser linker comprises (G$_4$S)$_4$ (SEQ ID NO: 48), and wherein the IL-2 variant is fused by the Gly-Ser linker to an IgG Fc region comprising an amino acid sequence chosen from SEQ ID NO: 39, SEQ ID NO: 40, SEQ ID NO: 41, SEQ ID NO: 42, SEQ ID NO: 43, SEQ ID NO: 44, SEQ ID NO: 45, SEQ ID NO: 46, SEQ ID NO: 47, or SEQ ID NO: 1003.

81. An IL-2 agent of paragraph 80, wherein the IL-2 agent comprises the IL-2 variant sequence comprising an amino acid sequence shown as SEQ ID NO: 4 or SEQ ID NO: 5.

82. An interleukin-2 (IL-2) agent comprising an amino acid sequence chosen from SEQ ID NO: 56, SEQ ID NO: 57, SEQ ID NO: 58, SEQ ID NO: 59, SEQ ID NO: 60, SEQ ID NO: 61, SEQ ID NO: 62, SEQ ID NO: 63, SEQ ID NO: 64, SEQ ID NO: 65, SEQ ID NO: 66, SEQ ID NO: 67, SEQ ID NO: 68, SEQ ID NO: 69, SEQ ID NO: 70, SEQ ID NO: 71, SEQ ID NO: 72, SEQ ID NO: 73, SEQ ID NO: 74, SEQ ID NO: 75, SEQ ID NO: 76, SEQ ID NO: 77, SEQ ID NO: 78, SEQ ID NO: 79, SEQ ID NO: 80, SEQ ID NO: 81, SEQ ID NO: 82, SEQ ID NO: 83, SEQ ID NO: 84, SEQ ID NO: 85, SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, SEQ ID NO: 1004, SEQ ID NO: 1005, SEQ ID NO: 1006, SEQ ID NO: 1007, SEQ ID NO: 1008, or SEQ ID NO: 1009, or a functional fragment thereof.

83. An interleukin-2 (IL-2) agent comprising an amino acid sequence chosen from SEQ ID NO: 1004, SEQ ID NO: 1005, SEQ ID NO: 1006, SEQ ID NO: 1007, SEQ ID NO: 1008, or SEQ ID NO: 1009 or a functional fragment thereof 84. An interleukin-2 (IL-2) agent comprising an amino acid sequence chosen from SEQ ID NO: 94, SEQ ID NO: 95, SEQ ID NO: 96, SEQ ID NO: 97, SEQ ID NO: 98, SEQ ID NO: 99, SEQ ID NO: 100, SEQ ID NO: 101, SEQ ID NO:

102, SEQ ID NO: 103, SEQ ID NO: 104, SEQ ID NO: 105, SEQ ID NO: 106, SEQ ID NO: 107, SEQ ID NO: 108, SEQ ID NO: 109, SEQ ID NO: 110, SEQ ID NO: 111, SEQ ID NO: 112, SEQ ID NO: 113, SEQ ID NO: 114, SEQ ID NO: 115, SEQ ID NO: 116, SEQ ID NO: 117, SEQ ID NO: 118, SEQ ID NO: 119, SEQ ID NO: 120, SEQ ID NO: 121, SEQ ID NO: 122, SEQ ID NO: 123, SEQ ID NO: 124, SEQ ID NO: 125, SEQ ID NO: 126, SEQ ID NO: 127, SEQ ID NO: 128, SEQ ID NO: 129, SEQ ID NO: 130, or SEQ ID NO: 131, or a functional fragment thereof.

85. An interleukin-2 (IL-2) agent comprising an amino acid sequence chosen from SEQ ID NO: 132, SEQ ID NO: 133, SEQ ID NO: 134, SEQ ID NO: 135, SEQ ID NO: 136, SEQ ID NO: 137, SEQ ID NO: 138, SEQ ID NO: 139, SEQ ID NO: 140, SEQ ID NO: 141, SEQ ID NO: 142, SEQ ID NO: 143, SEQ ID NO: 144, SEQ ID NO: 145, SEQ ID NO: 146, SEQ ID NO: 147, SEQ ID NO: 148, SEQ ID NO: 149, SEQ ID NO: 150, SEQ ID NO: 151, SEQ ID NO: 152, SEQ ID NO: 153, SEQ ID NO: 154, SEQ ID NO: 155, SEQ ID NO: 156, SEQ ID NO: 157, SEQ ID NO: 158, SEQ ID NO: 159, SEQ ID NO: 160, SEQ ID NO: 161, SEQ ID NO: 162, SEQ ID NO: 163, SEQ ID NO: 164, SEQ ID NO: 165, SEQ ID NO: 166, SEQ ID NO: 167, SEQ ID NO: 168, or SEQ ID NO: 169, or a functional fragment thereof.

86. An interleukin-2 (IL-2) agent comprising an amino acid sequence chosen from SEQ ID NO: 170, SEQ ID NO: 171, SEQ ID NO: 172, SEQ ID NO: 173, SEQ ID NO: 174, SEQ ID NO: 175, SEQ ID NO: 176, SEQ ID NO: 177, SEQ ID NO: 178, SEQ ID NO: 179, SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, or SEQ ID NO: 207, or a functional fragment thereof.

87. An interleukin-2 (IL-2) agent comprising an amino acid sequence chosen from SEQ ID NO: 208, SEQ ID NO: 209, SEQ ID NO: 210, SEQ ID NO: 211, SEQ ID NO: 212, SEQ ID NO: 213, SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, or SEQ ID NO: 245, or a functional fragment thereof.

88. An interleukin-2 (IL-2) agent comprising an amino acid sequence chosen from SEQ ID NO: 246, SEQ ID NO: 247, SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, SEQ ID NO: 281, SEQ ID NO: 282, or SEQ ID NO: 283, or a functional fragment thereof.

89. An interleukin-2 (IL-2) agent comprising an amino acid sequence chosen from SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, SEQ ID NO: 315, SEQ ID NO: 316, SEQ ID NO: 317, SEQ ID NO: 318, SEQ ID NO: 319, SEQ ID NO: 320, or SEQ ID NO: 321, or a functional fragment thereof.

90. An interleukin-2 (IL-2) agent comprising an amino acid sequence chosen from SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, SEQ ID NO: 349, SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, or SEQ ID NO: 359, or a functional fragment thereof.

91. An interleukin-2 (IL-2) agent comprising the amino acid sequence of SEQ ID NO: 59, or a functional fragment thereof.

92. An interleukin-2 (IL-2) agent comprising the amino acid sequence of SEQ ID NO: 97, or a functional fragment thereof.

93. An interleukin-2 (IL-2) agent comprising the amino acid sequence of SEQ ID NO: 135, or a functional fragment thereof.

94. An interleukin-2 (IL-2) agent comprising the amino acid sequence of SEQ ID NO: 173, or a functional fragment thereof.

95. An interleukin-2 (IL-2) agent comprising the amino acid sequence of SEQ ID NO: 211, or a functional fragment thereof.

96. An interleukin-2 (IL-2) agent comprising the amino acid sequence of SEQ ID NO: 249, or a functional fragment thereof.

97. An interleukin-2 (IL-2) agent comprising the amino acid sequence of SEQ ID NO: 287, or a functional fragment thereof.

98. An interleukin-2 (IL-2) agent comprising the amino acid sequence of SEQ ID NO: 325, or a functional fragment thereof.

99. An interleukin-2 (IL-2) agent comprising the amino acid sequence of SEQ ID NO: 66, or a functional fragment thereof.

100. An interleukin-2 (IL-2) agent comprising the amino acid sequence of SEQ ID NO: 104, or a functional fragment thereof.

101. An interleukin-2 (IL-2) agent comprising the amino acid sequence of SEQ ID NO: 142, or a functional fragment thereof.

103. An interleukin-2 (IL-2) agent comprising the amino acid sequence of SEQ ID NO: 180, or a functional fragment thereof.

104. An interleukin-2 (IL-2) agent comprising the amino acid sequence of SEQ ID NO: 218, or a functional fragment thereof.

105. An interleukin-2 (IL-2) agent comprising the amino acid sequence of SEQ ID NO: 256, or a functional fragment thereof.
106. An interleukin-2 (IL-2) agent comprising the amino acid sequence of SEQ ID NO: 294, or a functional fragment thereof.
107. An interleukin-2 (IL-2) agent comprising the amino acid sequence of SEQ ID NO: 332, or a functional fragment thereof.
108. An interleukin-2 (IL-2) agent comprising the amino acid sequence of SEQ ID NO: 60, or a functional fragment thereof.
109. An interleukin-2 (IL-2) agent comprising the amino acid sequence of SEQ ID NO: 98, or a functional fragment thereof.
110. An interleukin-2 (IL-2) agent comprising the amino acid sequence of SEQ ID NO: 136, or a functional fragment thereof.
111. An interleukin-2 (IL-2) agent comprising the amino acid sequence of SEQ ID NO: 174, or a functional fragment thereof.
112. An interleukin-2 (IL-2) agent comprising the amino acid sequence of SEQ ID NO: 212, or a functional fragment thereof.
113. An interleukin-2 (IL-2) agent comprising the amino acid sequence of SEQ ID NO: 250, or a functional fragment thereof.
114. An interleukin-2 (IL-2) agent comprising the amino acid sequence of SEQ ID NO: 288, or a functional fragment thereof.
115. An interleukin-2 (IL-2) agent comprising the amino acid sequence of SEQ ID NO: 326, or a functional fragment thereof.
116. An interleukin-2 (IL-2) agent comprising the amino acid sequence of SEQ ID NO: 69, or a functional fragment thereof.
117. An interleukin-2 (IL-2) agent comprising the amino acid sequence of SEQ ID NO: 107, or a functional fragment thereof.
118. An interleukin-2 (IL-2) agent comprising the amino acid sequence of SEQ ID NO: 145, or a functional fragment thereof.
119. An interleukin-2 (IL-2) agent comprising the amino acid sequence of SEQ ID NO: 183, or a functional fragment thereof.
120. An interleukin-2 (IL-2) agent comprising the amino acid sequence of SEQ ID NO: 221, or a functional fragment thereof.
121. An interleukin-2 (IL-2) agent comprising the amino acid sequence of SEQ ID NO: 259, or a functional fragment thereof.
122. An interleukin-2 (IL-2) agent comprising the amino acid sequence of SEQ ID NO: 297, or a functional fragment thereof.
123. An interleukin-2 (IL-2) agent comprising the amino acid sequence of SEQ ID NO: 335, or a functional fragment thereof.
124. An interleukin-2 (IL-2) agent comprising the amino acid sequence of SEQ ID NO: 1004, or a functional fragment thereof.
125. An interleukin-2 (IL-2) agent comprising the amino acid sequence of SEQ ID NO: 1005, or a functional fragment thereof.
126. An interleukin-2 (IL-2) agent comprising the amino acid sequence of SEQ ID NO: 1006, or a functional fragment thereof.
127. An interleukin-2 (IL-2) agent comprising the amino acid sequence of SEQ ID NO: 1007, or a functional fragment thereof.
128. An interleukin-2 (IL-2) agent comprising the amino acid sequence of SEQ ID NO: 1008, or a functional fragment thereof.
129. An interleukin-2 (IL-2) agent comprising the amino acid sequence of SEQ ID NO: 1009, or a functional fragment thereof.
130. The IL-2 agent of any one of the preceding paragraphs, wherein the amino acid alteration(s) (e.g., substitution(s)) provides the IL-2 agent with at least one or more (e.g., 2, 3, 4, 5, 6, 7, 8, or all) of the following properties relative to a reference IL-2 agent that does not comprise the amino acid alteration(s) (e.g., substitution(s)):
   (i) enhanced or increased expression of the IL-2 agent;
   (ii) inhibited or decreased aggregation of the IL-2 agent;
   (iii) enhanced or increased stability of the IL-2 agent;
   (iv) enhanced or increased half-life of the IL-2 agent;
   (v) inhibited or decreased turnover and/or clearance of the IL-2 agent;
   (vi) inhibited or decreased (e.g., moderately inhibited or decreased) or substantially unchanged binding of the IL-2 agent to human CD25;
   (vii) inhibited or decreased affinity of the IL-2 agent for human CD122;
   (viii) inhibited or decreased affinity of the IL-2 agent for human CD132; or
   (ix) inhibited or decreased affinity of the IL-2 agent for the dimeric IL-2 receptor composed of human CD122 and human CD132;
   (x) selective binding to regulatory T cells (e.g., Foxp3+ T cells);
   (xi) selective activation of the IL-2 signaling pathway in Tregs; and/or
   (xii) enhanced or increased, or reduced or decreased, ability to induce or promote Treg expansion, activity, survival and/or proliferation.
131. The IL-2 agent of paragraph 130, wherein the reference IL-2 agent comprises the amino acid sequence of SEQ ID NO: 1031, SEQ ID NO: 1, or SEQ ID NO: 2, or a functional fragment thereof.
132. An interleukin-2 (IL-2) agent comprising: a human IL-2 variant comprising one or more amino acid alteration(s) (e.g., substitution(s)) chosen from H16D, H16N, H16L, I28T, K35E, R38Q, R38N, R38E, F42K, F42Q, V69A, Q74P, D84V, S87R, N88L, N88S, I92S, C125S; a polypeptide linker; and a non-IL-2 moiety; wherein the amino acid alteration(s) (e.g., substitution(s)) provide(s) the IL-2 agent with at least one or more of the following properties relative to a reference IL-2 agent that does not comprise the amino acid alteration(s) (e.g., substitution(s)):
   (i) enhanced or increased expression of the IL-2 agent;
   (ii) inhibited or decreased aggregation of the IL-2 agent;
   (iii) enhanced or increased stability of the IL-2 agent;
   (iv) enhanced or increased half-life of the IL-2 agent;
   (v) inhibited or decreased turnover and/or clearance of the IL-2 agent;
   (vi) inhibited or decreased (e.g., moderately inhibited or decreased) or substantially unchanged binding of the IL-2 agent to human CD25;
   (vii) inhibited or decreased affinity of the IL-2 agent for human CD122;
   (viii) inhibited or decreased affinity of the IL-2 agent for human CD132;

(ix) inhibited or decreased affinity of the IL-2 agent for the dimeric IL-2 receptor composed of human CD122 and human CD132;
(x) selective binding to regulatory T cells (e.g., Foxp3+ T cells);
(xi) selective activation of the IL-2 signaling pathway in Tregs; and/or
(xii) enhanced or increased, or reduced or decreased, ability to induce or promote Treg expansion, activity, survival, and/or proliferation.

133. The IL-2 agent of paragraph 132, wherein the human IL-2 variant comprises the amino acid alteration(s) (e.g., substitution(s)):
(i) C125S;
(ii) V69A, Q74P, and C125S;
(iii) H16D, V69A, Q74P, and C125S;
(iv) H16N, V69A, Q74P, and C125S;
(v) H16L, V69A, Q74P, and C125S;
(vi) I28T, V69A, Q74P, and C125S;
(vii) V69A, Q74P, D84V, and C125S;
(viii) V69A, Q74P, S87R, and C125S;
(ix) V69A, Q74P, N88L, and C125S;
(x) V69A, Q74P, N88S, and C125S;
(xi) V69A, Q74P, I92S, and C125S;
(xii) K35E, V69A, Q74P, and C125S;
(xiii) K35E, H16N, V69A, Q74P, and C125S;
(xiv) K35E, H16L, V69A, Q74P, and C125S;
(xv) K35E, D84V, V69A, Q74P, and C125S;
(xvi) K35E, I92S, V69A, Q74P, and C125S;
(xvii) R38Q, V69A, Q74P, and C125S;
(xviii) R38Q, H16N, V69A, Q74P, and C125S;
(xix) R38Q, H16L, V69A, Q74P, and C125S;
(xx) R38Q, D84V, V69A, Q74P, and C125S;
(xxi) R38Q, I92S, Q74P, and C125S;
(xxii) R38N, V69A, Q74P, and C125S;
(xxiii) R38N, H16N, V69A, Q74P, and C125S;
(xxiv) R38N, H16L, V69A, Q74P, and C125S;
(xxv) R38N, D84V, V69A, Q74P, and C125S;
(xxvi) R38N, I92S, Q74P, and C125S;
(xxvii) R38E, V69A, Q74P, and C125S;
(xxviii) F42K, V69A, Q74P, and C125S;
(xxix) F42Q, V69A, Q74P, and C125S;
(xxx) F42A, Y45A, L72G, N88D, V69A, Q74P, and C125S;
(xxxi) R38N, S87R, V69A, Q74P, and C125S;
(xxxii) R38E, H16N, V69A, Q74P, and C125S;
(xxxiii) R38E, D84V, V69A, Q74P, and C125S;
(xxxiv) R38E, S87R, V69A, Q74P, and C125S;
(xxxv) R38E, I92S, V69A, Q74P, and C125S;
(xxxvi) F42Q, H16N, V69A, Q74P, and C125S;
(xxxvii) F42Q, I92S, V69A, Q74P, and C125S;
(xxxviii) K35E, R38N, H16N, V69A, Q74P, and C125S;
(xxxix) T3A, H16N, V69A, Q74P, and C125S;
(xl) T3A, H16L, V69A, Q74P, and C125S; or
(xli) T3A, V69A, Q74P, I92S, and C125S.

134. The IL-2 agent of paragraph 133, wherein the human IL-2 variant comprises the amino acid alteration(s) (e.g., substitution(s)): (i) H16N, V69A, Q74P and C125S, or (ii) H16L, V69A, Q74P and C125S.

135. An interleukin-2 (IL-2) agent comprising a human IL-2 variant comprising an amino acid sequence chosen from SEQ ID NO: 2, SEQ ID NO: 3, SEQ ID NO: 4, SEQ ID NO: 5, SEQ ID NO: 6, SEQ ID NO: 7, SEQ ID NO: 8, SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, SEQ ID NO: 17, SEQ ID NO: 18, SEQ ID NO: 19, SEQ ID NO: 20, SEQ ID NO: 21, SEQ ID NO: 22, SEQ ID NO: 23, SEQ ID NO: 24, SEQ ID NO: 25, SEQ ID NO: 26, SEQ ID NO: 27, SEQ ID NO: 28, SEQ ID NO: 29, SEQ ID NO: 30, SEQ ID NO: 31, SEQ ID NO: 32, SEQ ID NO: 33, SEQ ID NO: 34, SEQ ID NO: 35, SEQ ID NO: 36, SEQ ID NO: 37, SEQ ID NO: 38, SEQ ID NO: 1000, SEQ ID NO: 1001, or SEQ ID NO: 1002, or a functional fragment thereof or an amino acid sequence with at least 90% sequence identity thereof; a polypeptide linker; and a non-IL-2 moiety; wherein the IL-2 agent exhibits at least one or more of the following properties relative to a reference IL-2 agent that does not comprise the human IL-2 polypeptide variant:
(i) enhanced or increased expression of the IL-2 agent;
(ii) inhibited or decreased aggregation of the IL-2 agent;
(iii) enhanced or increased stability of the IL-2 agent;
(iv) enhanced or increased half-life of the IL-2 agent;
(v) inhibited or decreased turnover and/or clearance of the IL-2 agent;
(vi) inhibited or decreased (e.g., moderately inhibited or decreased) or substantially unchanged binding of the IL-2 agent to human CD25;
(vii) inhibited or decreased affinity of the IL-2 agent for human CD122;
(viii) inhibited or decreased affinity of the IL-2 agent for human CD132;
(ix) inhibited or decreased affinity of the IL-2 agent for dimeric IL-2 receptor composed of human CD122 and human CD132;
(x) selective binding to regulatory T cells (e.g., Foxp3+ T cells); or
(xi) selective activation of the IL-2 signaling pathway in Tregs; or
(xii) enhanced or increased, or reduced or decreased, ability to induce or promote Treg expansion, activity and/or proliferation.

136. The IL-2 agent of paragraph 135, wherein the human IL-2 variant comprises the amino acid sequence shown as SEQ ID NO: 4 or SEQ ID NO: 5.

137. The IL-2 agent of any one of paragraphs 132-136, wherein the human IL-2 variant is fused to a non-IL-2 moiety by a linker, wherein the linker is a polypeptide linker, optionally wherein the polypeptide linker is a flexible linker, a rigid linker, or a cleavable linker.

138. The IL-2 agent of paragraph 137, wherein the polypeptide linker is a Gly-Ser linker (e.g., a (G4S)n linker, wherein n=1, 2, 3, 4, 5, 6 or more (SEQ ID NO: 1020)), a proline-rich extended linker (e.g., V1 GPc, V2, GPGc, V3 GcGcP, cellulase linker 4, cellulase linker 4), a rigid linker (e.g., A(EAAAK)nA, wherein n=2, 3, 4, 5, or more (SEQ ID NO: 1021); REPR_12), a non-GS linker (e.g., (GGGSA)n, wherein n=1, 2, 3, 4, 5, or more (SEQ ID NO: 1022)), or an immunoglobulin hinge region or portion thereof.

139. The IL-2 agent of paragraph 137 or 138, wherein the polypeptide linker is a Gly-Ser linker comprising (G4S)$_1$ (SEQ ID NO: 1023), (G4S)$_2$ (SEQ ID NO: 1024), (G4S)$_3$ (SEQ ID NO: 1025), (G4S)$_4$ (SEQ ID NO: 48), (G4S)$_5$ (SEQ ID NO: 1026), or (G4S)$_6$ (SEQ ID NO: 1027).

140. The IL-2 agent of paragraph 130, wherein the polypeptide linker is a Gly-Ser linker comprising (G4S)$_4$ (SEQ ID NO: 48).

141. The IL-2 agent of paragraph 137, wherein the polypeptide linker comprises an amino acid sequence chosen from SEQ ID NO: 48, SEQ ID NO: 49, SEQ ID NO: 50, SEQ ID NO: 51, SEQ ID NO: 52, SEQ ID NO: 53, SEQ ID NO: 54, or SEQ ID NO: 55.

142. The IL-2 agent of paragraph 141, wherein the polypeptide linker comprises the amino acid sequence of SEQ ID NO: 48.

143. The IL-2 agent of any one of paragraphs 132-142, wherein the non-IL-2 moiety is an immunoglobulin Fc region, or a fragment or portion thereof.

144. The IL-2 agent of paragraph 143, wherein the immunoglobulin Fc region comprises an IgG Fc region, an IgD Fc region, an IgA Fc region, an IgM Fc region, or an IgE Fc region, or fragment or portion thereof.

145. The IL-2 agent of paragraph 144, wherein the IgG Fc region comprises a wild type human IgG1 Fc region, a wild type IgG2 Fc region, or a wild type human IgG4 Fc region, or a fragment or portion thereof.

146. The IL-2 agent of paragraph 144, wherein the IgG Fc region comprises a mutant IgG1 (e.g., IgG1 m3 allotype) or mutant IgG4 Fc region, or a fragment or portion thereof.

147. The IL-2 agent of paragraph 146, comprising a mutant IgG4 Fc region, or a fragment or portion thereof, wherein the mutant IgG4 Fc region is human 148. The IL-2 agent of paragraph 146 or 147, wherein the mutant IgG4 Fc region, or fragment or portion thereof, comprises an amino acid alteration (e.g., substitution) at Ser228, numbering according to EU numbering, optionally wherein the amino acid alteration (e.g., substitution) at Ser228 is S228P.

149. The IL-2 agent of any one of paragraphs 146-148, wherein the mutant IgG4 Fc region, or fragment or portion thereof, comprises an amino acid alteration (e.g., substitution) at Arg409, numbering according to EU numbering, optionally wherein the amino acid alteration (e.g., substitution) at Arg409 is R409K.

150. The IL-2 agent of any one of paragraphs 146-149, wherein the mutant IgG4 Fc region, or a fragment or portion thereof, comprises amino acid alterations (e.g., substitutions) at Thr307, Gln311, and Ala378, numbering according to EU numbering, optionally wherein the amino acid alterations (e.g., substitutions) are T307Q, Q311V, and A378V, respectively.

151. The IL-2 agent of paragraph 146 or 147, wherein the mutant IgG4 Fc region comprises an amino acid sequence chosen from SEQ ID NO: 44, SEQ ID NO: 45, SEQ ID NO: 46, or SEQ ID NO: 47.

152. The IL-2 agent of paragraph 146, comprising a mutant IgG1 Fc region, or a fragment or portion thereof, wherein the mutant IgG1 Fc region is human.

153. The IL-2 agent of paragraph 146 or 152, wherein the mutant IgG1 Fc region, or a fragment or portion thereof, comprises an amino acid alteration (e.g., substitution) at Asn297, numbering according to EU numbering, optionally wherein the amino acid alteration (e.g., substitution) at Asn297 is N297G.

154. The IL-2 agent of paragraph 146 or 152, wherein the mutant IgG1 Fc region, or a fragment or portion thereof, comprises amino acid alterations (e.g., substitutions) at Leu234, Leu235, and Pro329, numbering according to EU numbering, optionally wherein the amino acid alterations (e.g., substitutions are L234A, L235A, and P329G, respectively.

155. The IL-2 agent of any one of paragraphs 146 or 152-154, wherein the mutant IgG1 Fc region, or a fragment or portion thereof, comprises amino acid alterations (e.g., substitutions) at Thr307, Gln311, and Ala378, numbering according to EU numbering, optionally wherein the amino acid alterations (e.g., substitutions) are T307Q, Q311V, and A378V, respectively.

156. The IL-2 agent of paragraph 146 or 152, wherein the mutant IgG1 Fc region comprises an amino acid sequence chosen from SEQ ID NO: 40, SEQ ID NO: 41, SEQ ID NO: 42, SEQ ID NO: 43, or SEQ ID NO: 1003.

157. The IL-2 agent of any one of paragraphs 132-156, wherein the non-IL-2 moiety inhibits or decreases the ability of the IL-2 agent to elicit Fc-receptor-mediated immune effector functions.

158. The IL-2 agent of any one of paragraphs 132-157, wherein the reference IL-2 agent comprises the amino acid sequence of SEQ ID NO: 1031, SEQ ID NO: 1, or SEQ ID NO: 2.

159. The IL-2 agent of any one of the preceding paragraphs, which forms a dimer (e.g., a homodimer or heterodimer).

160. The IL-2 agent of any one of the preceding paragraphs, comprising an IL-2 agent/anti-IL-2 antibody complex.

161. The IL-2 agent of any one of the preceding paragraphs, comprising a conjugate.

162. A pharmaceutical composition comprising the IL-2 agent of any one of the preceding paragraphs, and a pharmaceutically acceptable carrier.

163. A nucleic acid encoding the IL-2 agent of any one of the preceding paragraphs.

164. A vector (e.g., expression vector) comprising the nucleic acid of paragraph 163.

165. A cell comprising the nucleic acid of paragraph 135 or the vector of paragraph 164.

166. A method of producing an IL-2 agent, comprising culturing (e g, maintaining) the cell of paragraph 156 under conditions permitting expression of the IL-2 agent.

167. The method of paragraph 157, further comprising obtaining the IL-2 agent.

168. A method of enhancing regulatory T cell (Treg) expansion, activity, survival, and/or proliferation, comprising contacting a Treg cell or a population of Treg cells (e.g., in vitro, ex vivo, or in vivo) or administering to a subject in need thereof an effective amount of the IL-2 agent of any one of paragraphs 1-152, or the pharmaceutical composition of paragraph 153.

169. A method of selectively activating the IL-2 signaling pathway in regulatory T cells (Tregs), comprising contacting a Treg cell or a population of Treg cells (e.g., in vitro, ex vivo, or in vivo) or administering to a subject in need thereof an effective amount of the IL-2 agent of any one of paragraphs 1-161, or the pharmaceutical composition of paragraph 162.

170. A method of inducing immune tolerance in a subject in need thereof, comprising administering an effective amount of the IL-2 agent of any one of paragraphs 1-161, or the pharmaceutical composition of paragraph 162.

171. A method of treating a disorder (e.g., an autoimmune disease, a cancer) comprising administering to a subject in need thereof an effective amount of the IL-2 agent of any one of paragraphs 1-161, or the pharmaceutical composition of paragraph 162.

172. A composition for use in a method for the treatment of a disorder (e.g., an autoimmune disease or a cancer), the method comprising administering to a subject in need thereof the IL-2 agent of any one of paragraph 1-161, or the pharmaceutical composition of paragraph 162.

173. A kit comprising the IL-2 agent of any one of paragraph 1-161, or the pharmaceutical composition of paragraph 162, and instructions for use.

174. A container comprising the IL-2 agent of any one of paragraph 1-161, or the pharmaceutical composition of paragraph 162.

175. A method of treating a disorder (e.g., an autoimmune disease, a cancer) comprising administering to a subject in need thereof an effective amount of the nucleic acid of paragraph 163.

176. A composition for use in a method for the treatment of a disorder (e.g., an autoimmune disease or a cancer), the method comprising administering to a subject in need thereof the nucleic acid of paragraph 163.

The present disclosure further includes any of the following numbered embodiments:
1. An interleukin-2 (IL-2) variant, comprising:
   (i) the amino acid substitution H16L or H16N, and/or the amino acid substitution I92S, and
   (ii) the amino acid substitutions V69A, Q74P, and C125S, corresponding to wild-type human IL-2 (e.g., SEQ ID NO: 1031).
2. The IL-2 variant of embodiment 1, further comprising the amino acid substitution T3A.
3. The IL-2 variant of embodiment 1 or 2, comprising the amino acid sequence of any of SEQ ID NOs: 4, 5, 11, 1000, 1001, or 1002, an amino acid sequence that is at least 95% identical thereto or differs by no more than 1, 2, 3, 4, or 5 amino acids therefrom, or a functional fragment thereof.
4. The IL-2 variant of any of embodiments 1-3, which selectively stimulates regulatory T cells (Tregs).
5. An IL-2 fusion protein comprising the IL-2 variant of any of embodiments 1-4.
6. The IL-2 fusion protein of embodiment 5, further comprising an Fc region.
7. The IL-2 fusion protein of embodiment 6, wherein the Fc region comprises an Fc region of IgG1 allotype m3 comprising an N297G substitution according to EU numbering.
8. The IL-2 fusion protein of embodiment 6 or 7, wherein the Fc region comprises the amino acid sequence of SEQ ID NO: 1003, or an amino acid sequence that is at least 95% identical thereto or differs by no more than 1, 2, 3, 4, 5, 6, 7, 8, 9, or 10 amino acids therefrom, or a functional fragment thereof.
9. The IL-2 fusion protein of any of embodiments 6-8, wherein the Fc region is fused to the C-terminus of the IL-2 variant.
10. The IL-2 fusion protein of any of embodiments 6-9, further comprising a linker.
11. The IL-2 fusion protein of embodiment 10, wherein the linker comprises $(G_4S)_4$ (SEQ ID NO: 48).
12. The IL-2 fusion protein of any of embodiments 6-11, comprising an amino acid sequence of any of SEQ ID NOs: 1004, 1005, 1006, 1007, 1008, or 1009, an amino acid sequence that is at least 95% identical thereto or differs by no more than 1, 2, 3, 4, 5, 6, 7, 8, 9, or 10 amino acids therefrom, or a functional fragment thereof.
13. The IL-2 fusion protein of any of embodiments 6-12, which forms a dimer.
14. An IL-2 complex comprising the IL-2 variant of any of embodiments 1-4 and an anti-IL-2 antibody molecule.
15. An IL-2 conjugate comprising the IL-2 variant of any of embodiments 1-4 and a non-IL-2 moiety.
16. A pharmaceutical composition comprising the IL-2 variant of any of embodiments 1-4 and a pharmaceutically acceptable carrier.
17. A pharmaceutical composition comprising the IL-2 fusion protein of any of embodiments 5-13 and a pharmaceutically acceptable carrier.
18. A pharmaceutical composition comprising the IL-2 complex of embodiment 14 and a pharmaceutically acceptable carrier.
19. A pharmaceutical composition comprising the IL-2 conjugate of embodiment 15 and a pharmaceutically acceptable carrier.
20. A nucleic acid encoding the IL-2 variant of any of embodiments 1-4.
21. A nucleic acid encoding the IL-2 fusion protein any of embodiments 5-13.
22. A nucleic acid encoding the IL-2 complex of embodiment 14.
23. A nucleic acid encoding the IL-2 conjugate of embodiment 15.
24. A vector comprising the nucleic acid of embodiment 20.
25. A vector comprising the nucleic acid of embodiment 21.
26. A vector comprising the nucleic acid of embodiment 22.
27. A vector comprising the nucleic acid of embodiment 23.
28. A cell comprising the nucleic acid of embodiment 20.
29. A cell comprising the nucleic acid of embodiment 21.
30. A cell comprising the nucleic acid of embodiment 22.
31. A cell comprising the nucleic acid of embodiment 23.
32. A method of producing an IL-2 variant, comprising culturing the cell of embodiment 28 under conditions that allow expression of the IL-2 variant.
33. A method of producing an IL-2 fusion protein, comprising culturing the cell of embodiment 29 under conditions that allow expression of the IL-2 fusion protein.
34. A method of producing an IL-2 complex, comprising culturing the cell of embodiment 30 under conditions that allow expression of the IL-2 complex.
35. A method of producing an IL-2 conjugate, comprising culturing the cell of embodiment 31 under conditions that allow expression of the IL-2 conjugate.
36. A method of enhancing regulatory T cell (Treg) expansion, activity, survival, and/or proliferation, comprising contacting a Treg cell or a population of Treg cells in vitro, ex vivo, or in vivo, or administering to a subject in need thereof an effective amount of the IL-2 variant of any of embodiments 1-4.
37. A method of enhancing regulatory T cell (Treg) expansion, activity, survival, and/or proliferation, comprising contacting a Treg cell or a population of Treg cells in vitro, ex vivo, or in vivo, or administering to a subject in need thereof an effective amount of the IL-2 fusion protein of any of embodiments 5-13.
38. A method of enhancing regulatory T cell (Treg) expansion, activity, survival, and/or proliferation, comprising contacting a Treg cell or a population of Treg cells in vitro, ex vivo, or in vivo, or administering to a subject in need thereof an effective amount of the IL-2 complex of embodiment 14.
39. A method of enhancing regulatory T cell (Treg) expansion, activity, survival, and/or proliferation, comprising contacting a Treg cell or a population of Treg cells in vitro, ex vivo, or in vivo, or administering to a subject in need thereof an effective amount of the IL-2 conjugate of embodiment 15.
40. A method of selectively activating the IL-2 signaling pathway in regulatory T cells (Tregs), comprising contacting a Treg cell or a population of Treg cells in vitro, ex vivo, or in vivo, or administering to a subject in need thereof an effective amount of the IL-2 variant of any of embodiments 1-4.
41. A method of selectively activating the IL-2 signaling pathway in regulatory T cells (Tregs), comprising contacting a Treg cell or a population of Treg cells in vitro, ex vivo, or in vivo, or administering to a subject in need thereof an effective amount of the IL-2 fusion protein of any of embodiments 5-13.
42. A method of selectively activating the IL-2 signaling pathway in regulatory T cells (Tregs), comprising contacting a Treg cell or a population of Treg cells in vitro, ex vivo, or in vivo, or administering to a subject in need thereof an effective amount of the IL-2 complex of embodiment 14.
43. A method of selectively activating the IL-2 signaling pathway in regulatory T cells (Tregs), comprising contacting a Treg cell or a population of Treg cells in vitro, ex vivo, or in vivo, or administering to a subject in need thereof an effective amount of the IL-2 conjugate of embodiment 15.

44. A method of inducing immune tolerance, comprising administering to a subject in need thereof an effective amount of the IL-2 variant of any of embodiments 1-4.

45. A method of inducing immune tolerance, comprising administering to a subject in need thereof an effective amount of the IL-2 fusion protein of embodiment 5-13.

46. A method of inducing immune tolerance, comprising administering to a subject in need thereof an effective amount of the IL-2 complex of embodiment 14.

47. A method of inducing immune tolerance, comprising administering to a subject in need thereof an effective amount of the IL-2 conjugate of embodiment 15.

48. A method of treating an autoimmune disease, comprising administering to a subject in need thereof an effective amount of the IL-2 variant of any of embodiments 1-4.

49. A method of treating an autoimmune disease, comprising administering to a subject in need thereof an effective amount of the IL-2 fusion protein of any of embodiments 5-13.

50. A method of treating an autoimmune disease, comprising administering to a subject in need thereof an effective amount of the IL-2 complex of embodiment 14.

51. A method of treating an autoimmune disease, comprising administering to a subject in need thereof an effective amount of the IL-2 conjugate of embodiment 15.

52. A method of treating lupus nephritis, comprising administering to a subject in need thereof an effective amount of the IL-2 variant of any of embodiments 1-4.

53. A method of treating lupus nephritis, comprising administering to a subject in need thereof an effective amount of the IL-2 fusion protein of any of embodiments 5-13.

54. A method of treating lupus nephritis, comprising administering to a subject in need thereof an effective amount of the IL-2 complex of embodiment 14.

55. A method of treating lupus nephritis, comprising administering to a subject in need thereof an effective amount of the IL-2 conjugate of embodiment 15.

56. A method of treating autoimmune hepatitis, comprising administering to a subject in need thereof an effective amount of the IL-2 variant of any of embodiments 1-4.

57. A method of treating autoimmune hepatitis, comprising administering to a subject in need thereof an effective amount of the IL-2 fusion protein of any of embodiments 5-13.

58. A method of treating autoimmune hepatitis, comprising administering to a subject in need thereof an effective amount of the IL-2 complex of embodiment 14.

59. A method of treating autoimmune hepatitis, comprising administering to a subject in need thereof an effective amount of the IL-2 conjugate of embodiment 15.

60. A method of treating nephrotic syndrome, comprising administering to a subject in need thereof an effective amount of the IL-2 variant of any of embodiments 1-4.

61. A method of treating nephrotic syndrome, comprising administering to a subject in need thereof an effective amount of the IL-2 fusion protein of any of embodiments 5-13.

62. A method of treating nephrotic syndrome, comprising administering to a subject in need thereof an effective amount of the IL-2 complex of embodiment 14.

63. A method of treating nephrotic syndrome, comprising administering to a subject in need thereof an effective amount of the IL-2 conjugate of embodiment 15.

64. A kit comprising the IL-2 variant of any of embodiments 1-4 and instructions for use.

65. A kit comprising the IL-2 fusion protein of any of embodiments 5-13 and instructions for use.

66. A kit comprising the IL-2 complex of embodiment 14 and instructions for use.

67. A kit comprising the IL-2 conjugate of embodiment 15 and instructions for use.

68. The IL-2 variant of any of embodiments 1-4 for use in a method of inducing immune tolerance in a subject.

69. The IL-2 fusion protein of any of embodiments 5-13 for use in a method of inducing immune tolerance in a subject.

70. The IL-2 complex of embodiment 14 for use in a method of inducing immune tolerance in a subject.

71. The IL-2 conjugate of embodiment 15 for use in a method of inducing immune tolerance in a subject.

72. The IL-2 variant of any of embodiments 1-4 for use in a method of treating an autoimmune disease in a subject.

73. The IL-2 fusion protein of any of embodiments 5-13 for use in a method of an autoimmune disease in a subject.

74. The IL-2 complex of embodiment 14 for use in a method of an autoimmune disease in a subject.

75. The IL-2 conjugate of embodiment 15 for use in a method of an autoimmune disease in a subject.

76. The IL-2 variant of any of embodiments 1-4 for use in a method of treating lupus nephritis in a subject.

77. The IL-2 fusion protein of any of embodiments 5-13 for use in a method of treating lupus nephritis in a subject.

78. The IL-2 complex of embodiment 14 for use in a method of treating lupus nephritis in a subject.

79. The IL-2 conjugate of embodiment 15 for use in a method of treating lupus nephritis in a subject.

80. The IL-2 variant of any of embodiments 1-4 for use in a method of treating autoimmune hepatitis in a subject.

81. The IL-2 fusion protein of any of embodiments 5-13 for use in a method of treating autoimmune hepatitis in a subject.

82. The IL-2 complex of embodiment 14 for use in a method of treating autoimmune hepatitis in a subject.

83. The IL-2 conjugate of embodiment 15 for use in a method of treating autoimmune hepatitis in a subject.

84. The IL-2 variant of any of embodiments 1-4 for use in a method of treating nephrotic syndrome in a subject.

85. The IL-2 fusion protein of any of embodiments 5-13 for use in a method of treating nephrotic syndrome in a subject.

86. The IL-2 complex of embodiment 14 for use in a method of treating nephrotic syndrome in a subject.

87. The IL-2 conjugate of embodiment 15 for use in a method of treating nephrotic syndrome in a subject.

EXAMPLES

Example 1: Identification of Mutations That Prevent Aggregation of IL-2

A library of open reading frames (ORFs) encoding human IL-2 muteins was generated by site-saturation mutagenesis (a mutagenesis technique wherein the resulting library comprises a collection of ORFs each with single point mutations such that every amino acid is represented at every position within the ORF). To improve stability and prevent incorrect disulfide pairing, all IL-2 molecules discussed in the Examples contain the mutation C125S, as shown in FIG. 1B.

PCR amplicons comprising the library of ORFs encoding the IL-2 muteins were subsequently cloned into a yeast expression vector, allowing for fusion of each mutagenized human IL-2 mutein to an HA-tag and Myc-tag and to a yeast Aga2p polypeptide. The resulting yeast expression vector was used to transform yeast cells, as described in Boder and Wittrup (1997) Nat Biotechnol 15(6):553-557. Yeast cells clonally expressing the IL-2 mutein library were sorted once using fluorescence-activated cell sorting (FACS) for clones expressing full-length IL-2 muteins, as indicated by the presence of both Myc and HA tags.

Figure 2:
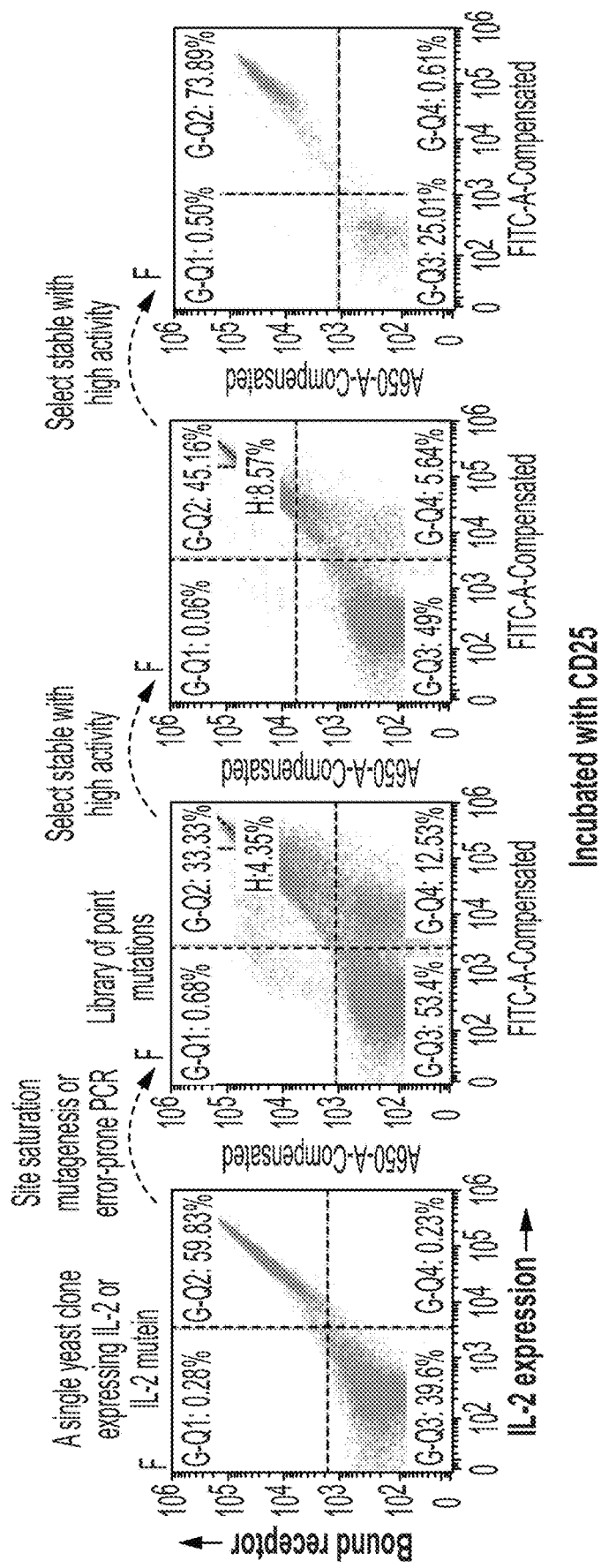
FIG. 2 provides a schematic illustrating a cell-based method to generate libraries of IL-2 variants using yeast surface display, and to select stable and active clones from those libraries. Mutations of IL-2 or an IL-2 variant expressed by an initial clone are generated by DNA synthesis or error-prone PCR and transformed into yeast cells. Yeast cells are stained with anti-Myc antibody and fluorescent secondary antibody to determine IL-2 expression (x-axis), and with recombinant CD25, anti-6xHis antibody ("6xHis" disclosed as SEQ ID NO: 1028) and fluorescent secondary antibody to measure bound CD25 (y-axis). In some versions of the experiment, an HA-tag is used in addition to or in place of the Myc-tag. Fluorescence-activated cell sorting is used to enrich IL-2 variants showing both high expression and high binding activity.

The resulting population was then sorted twice to further select clones that showed both high expression of the encoded IL-2 mutein, as measured by staining with anti-Myc antibody and appropriate fluorescent secondary antibody, and high binding capacity of the expressed IL-2 mutein for the low affinity IL-2 receptor (IL2-Ra/CD25) (FIG. 2). Specifically, yeast cells were incubated with varying levels of recombinant human CD25 containing 6xHis tag ("6xHis" disclosed as SEQ ID NO: 1028), and the amount of bound CD25 was determined by flow cytometry using anti-6xHis antibody ("6xHis" disclosed as SEQ ID NO: 1028) and appropriate fluorescent secondary antibody. Sanger sequencing of individual clones and sequencing of the entire population using next-generation sequencing were used to identify enriched mutations.

Figure 3A:
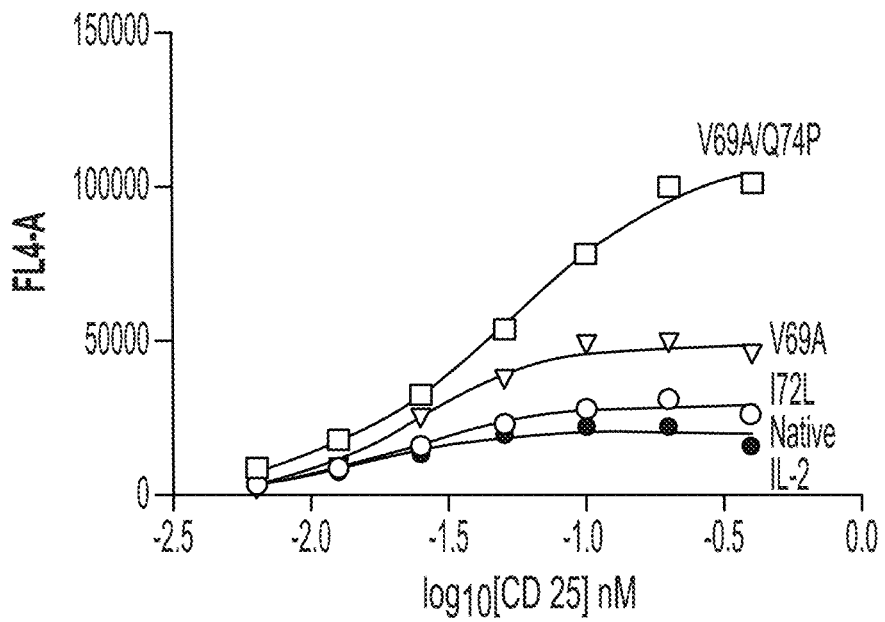
FIG. 3A provides a graph depicting the results of a method using IL-2 receptor titration to determine the affinity and binding capacity of IL-2 muteins displayed on the surface of yeast. Yeast clones expressing the indicated IL-2 muteins were incubated with a range of concentrations of CD25 extracellular domain tagged with 6xHis ("6xHis" disclosed as SEQ ID NO: 1028). Bound CD25 was measured by staining with anti-6xHis antibody ("6xHis" disclosed as SEQ ID NO: 1028) and fluorescent secondary antibody. Several exemplary IL-2 muteins are shown. Curve fitting was used to determine the binding affinity ($K_D$) and maximum binding signal (data not shown).
Figure 3B:
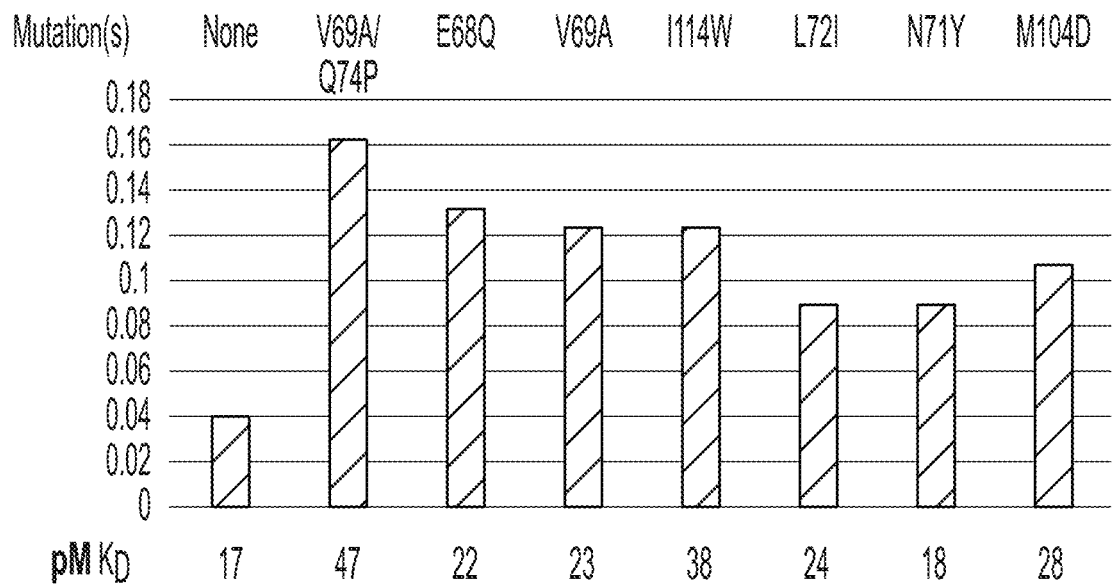
FIG. 3B provides a graph depicting the relative binding capacity for selected IL-2 muteins (maximum binding signal normalized to IL-2 expression level).

The V69A mutation appeared with very high frequency after performing the sorting steps. This mutation has been reported, in conjunction with Q74P, to increase affinity for CD25 as described in Rao et al. (2005) Biochem 44:10696-10701. To confirm this observation, an IL-2 mutein comprising the amino acid substitutions V69A/Q74P was evaluated in the following assays. Briefly, individual yeast clones expressing IL-2 or IL-2 muteins having amino acid substitution(s) V69A/Q74P, E68Q, V69A, I114W, L72I, N71Y, or M104D on their surface were titrated with recombinant CD25 to determine the binding affinity ($K_D$) and the relative fraction of active IL-2 molecules on the yeast surface (as determined by the relative binding capacity=the ratio of bound CD25 to expressed IL-2 mutein). Several mutations greatly increased the fraction of active IL-2 molecules expressed on the yeast cell surface, but none increased binding affinity for CD25. In disagreement with the previous report, V69A/Q74P decreased binding affinity to CD25 (FIG. 3A) while providing the highest observed fraction of active IL-2 molecules tested (FIG. 3B). These results indicate that the V69A/Q74P substitutions do not increase the binding affinity of the IL-2 molecule for CD25, but rather stabilize the IL-2 molecule in an active conformation sufficient for binding to CD25.

Figure 4A:
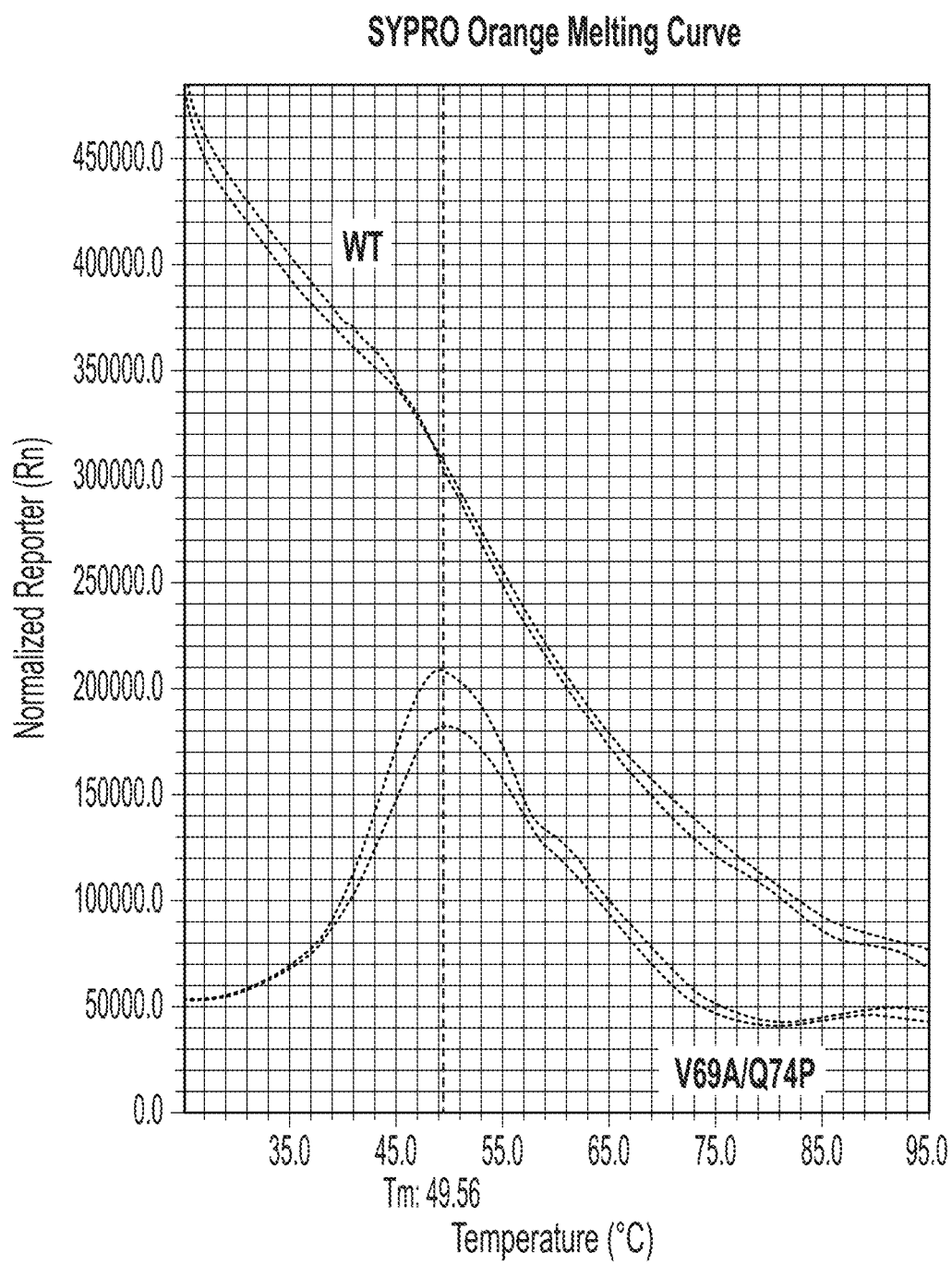
FIG. 4A provides a graph illustrating thermal denaturation (melting curves) of selected IL-2 agents (IL-2-Fc fusion proteins) as determined by SYPRO Orange fluorescence. The native IL-2-Fc fusion showed maximum signal at low temperature, indicating presence of unfolding protein, while the V69A/Q74P mutein shows an unfolding event as temperature increases.
Figure 4B:
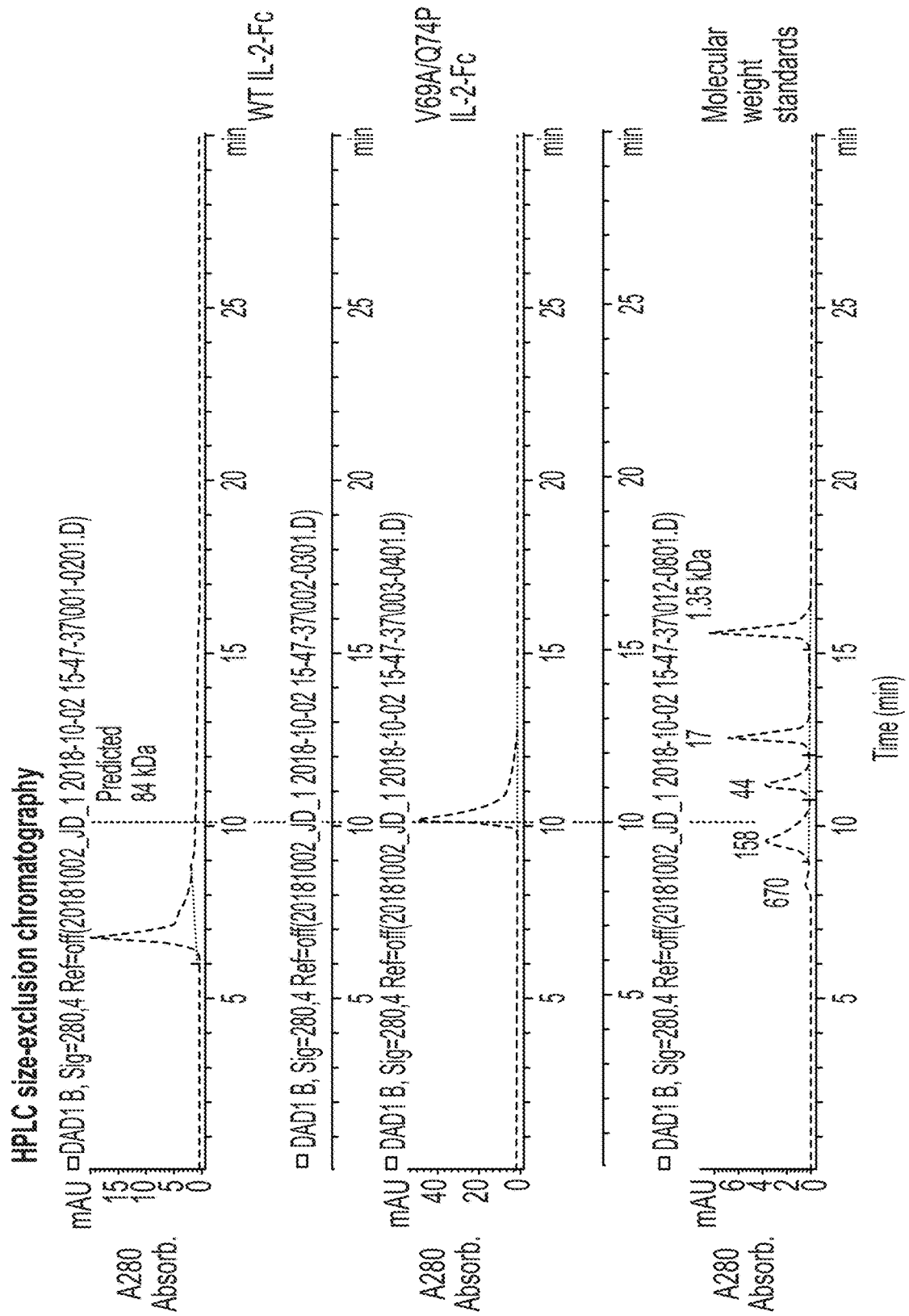
FIG. 4B provides a HPLC size-exclusion chromatogram showing that most of the native IL-2-Fc fusion elutes very early from the column (>670 kDa), indicative of unfolded protein aggregation. In contrast, the V69A/Q74P IL-2-Fc elutes as a single peak at the expected time for an 84 kDa protein.

To further evaluate the effect of the V69A/Q74P substitutions on IL-2 stability, both the wild-type IL-2 sequence and the V69A/Q74P IL-2 sequence were cloned into a plasmid for expression in human cells as a fusion with the Fc portion of human IgG1, which includes the mutation N297G to remove a glycosylation site on the Fc (SEQ ID NO: 40). Both proteins were transfected into the Expi293 expression system (Thermo Fisher Scientific), purified from supernatant using protein A, and analyzed for stability. The fusion protein containing wild-type IL-2 (WT) was largely aggregated as determined by both analysis of its melting temperature (FIG. 4A) and by size-exclusion chromatography (FIG. 4B). Taken together, the combination of assays using yeast surface expression and analysis of IL-2-Fc fusion proteins exemplifies mutations, especially V69A and the combination V69A/Q74P, that increase the stability of IL-2 with no more than a minimal effect on binding affinity for CD25.

Example 2: Generation of IL-2 Muteins that Reduce Binding Affinity to Components of the Intermediate-Affinity IL-2 Receptor (CD122, CD132, or CD122/CD132 Dimer)

IL-2 muteins were generated by using error-prone PCR to introduce random mutations into the nucleotide sequence of a gene encoding a human IL-2 polypeptide having the amino acid substitutions V69A and Q74P. Yeast cells expressing IL-2 muteins were incubated with recombinant 6xHis-tagged ("6xHis" disclosed as SEQ ID NO: 1028) CD25 followed by FACS analysis to isolate yeast cell clones expressing high-levels of fully functional/active IL-2 muteins as in Example 1.

Figures 5A, 5B:
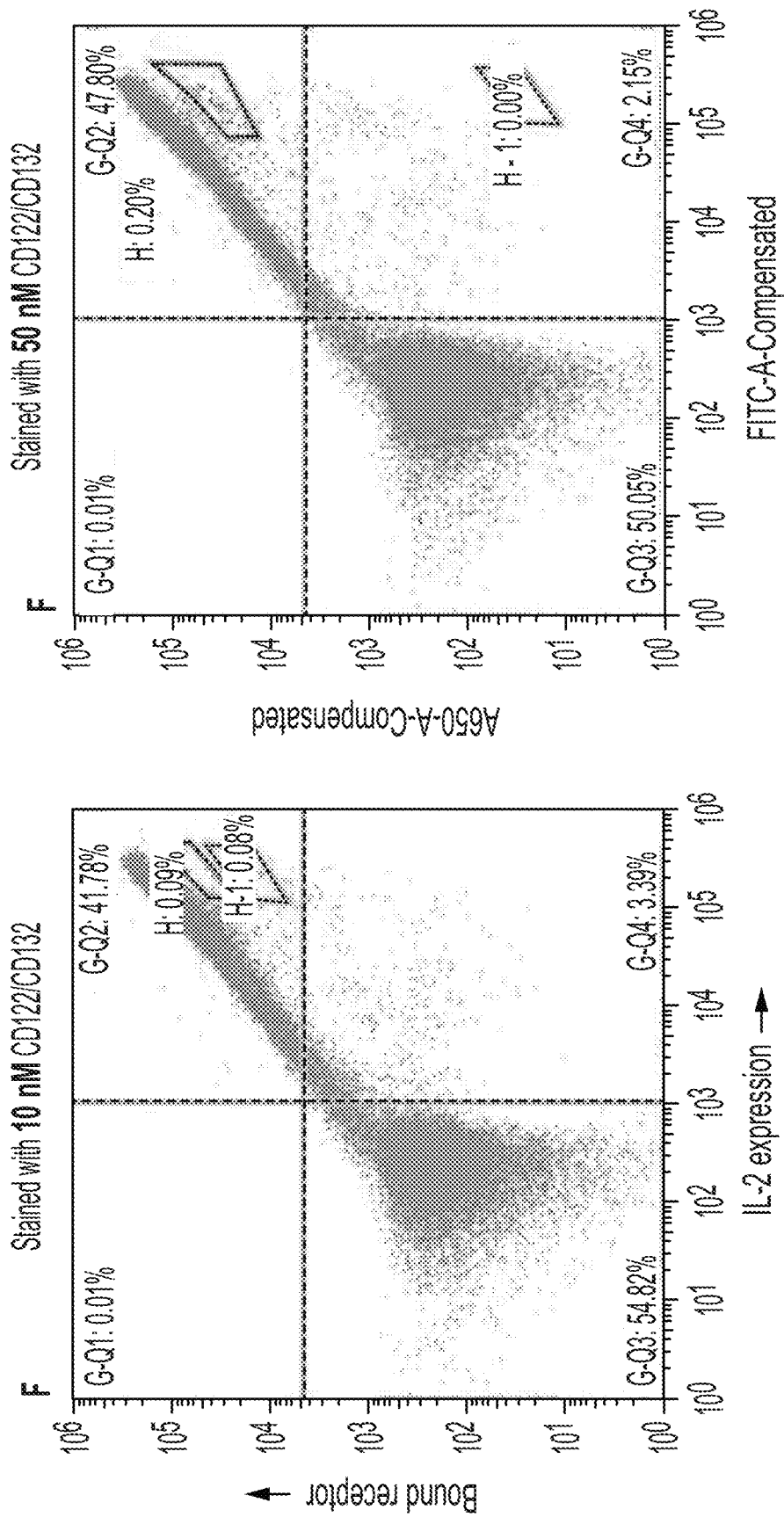
FIGS. 5A-5B provide scatterplots showing the results of a yeast cell sorting procedure used to identify mutations that affect the interaction with CD122 and/or CD132 IL-2 receptors. Yeast expressing a library of IL-2 variants on their surface were stained with CD122/CD132 Fc heterodimer at the indicated concentration, and bound receptors were detected using a fluorescent anti-human Fc secondary antibody. Surface IL-2 expression was detected with anti-Myc antibody and fluorescent secondary antibody. Cells within the indicate gates (boxes) were sorted and recovered, and the IL-2 muteins enriched in these populations determined by a combination of Sanger sequencing and next-generation sequencing.
Figure 6B:
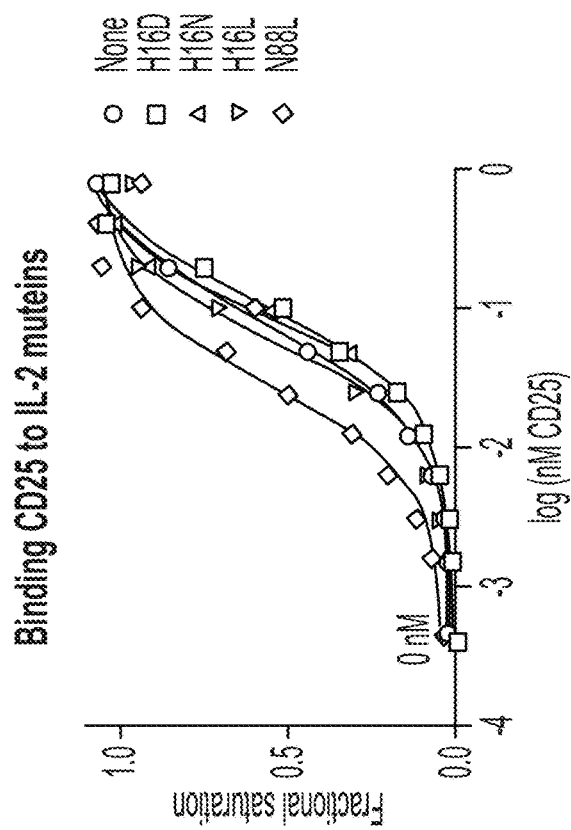
FIG. 6B provides a graph showing the results of the same method as FIG. 6A except that selected muteins are incubated with 6×His-tagged ("6×His" disclosed as SEQ ID NO: 1028) recombinant CD25 extracellular domain, and bound CD25 detected with anti-6×His antibody ("6×His" disclosed as SEQ ID NO: 1028).
Figure 6A:
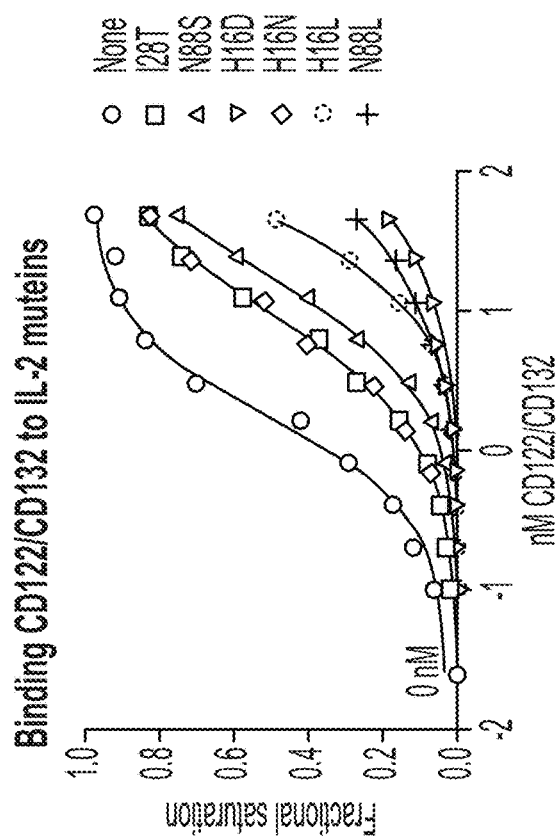
FIG. 6A provides a graph showing the results of a method to determine fractional saturation of yeast expressing the indicated IL-2 mutein on their surface after titration with CD122/CD132 Fc heterodimer at the indicated concentrations. All muteins depicted contain V69A/Q74P in addition to the indicated mutation. Bound CD122/CD132 was labeled using an anti-human Fc fluorescent secondary and measured using an Accuri C6 flow cytometer. Fractional saturation was calculated by fitting each curve to a 4-parameter dose response to estimate maximum binding signal for each curve, then normalized so the estimated maximum is defined as 1.

FACS analysis was further used to isolate yeast cell clones expressing IL-2 muteins with reduced binding to the dimeric IL-2 receptor (CD122/CD132). The CD122/CD132 IL-2 receptor was generated as a heterodimer by expressing CD122 fused to an IgG1 Fc and CD132 fused to a different Fc with mutations introduced into each Fc so that they selectively pair with each other (a knob-hole heterodimer) when expressed together in the same cell (knob mutations S354C/T366Q and hole mutations Y349C/T366S/L368A/Y407V as reviewed in Liu et al. (2017) Frontiers in Immunology 8:38). After staining yeast cells with 10 nM (FIG. 5A) or 50 nM (FIG. 5B) of CD122/CD132 heterodimer, the bound receptor dimer was detected using anti-human Fc fluorescent secondary antibody and sorted with various gates as shown (FIGS. 5A and 5B). Clones enriched by each sorting strategy were determined as in Example 1. Receptor binding affinities of selected yeast cell clones were measured by titrating yeast cells with a concentration range of CD122/CD132 heterodimer (FIG. 6A) or with recombinant extracellular domain of CD25 IL-2 receptor (FIG. 6B). The amount of bound antibody was measured by flow cytometry on an Accuri C6 or IntelliCyt iQue flow cytometer and curve fitting used to determine the $K_D$ (Table 2). Overall, mutations selected for reduced binding to CD122/CD132 Fc heterodimer show reduced binding affinity to that receptor but not to CD25.

Figure 7:
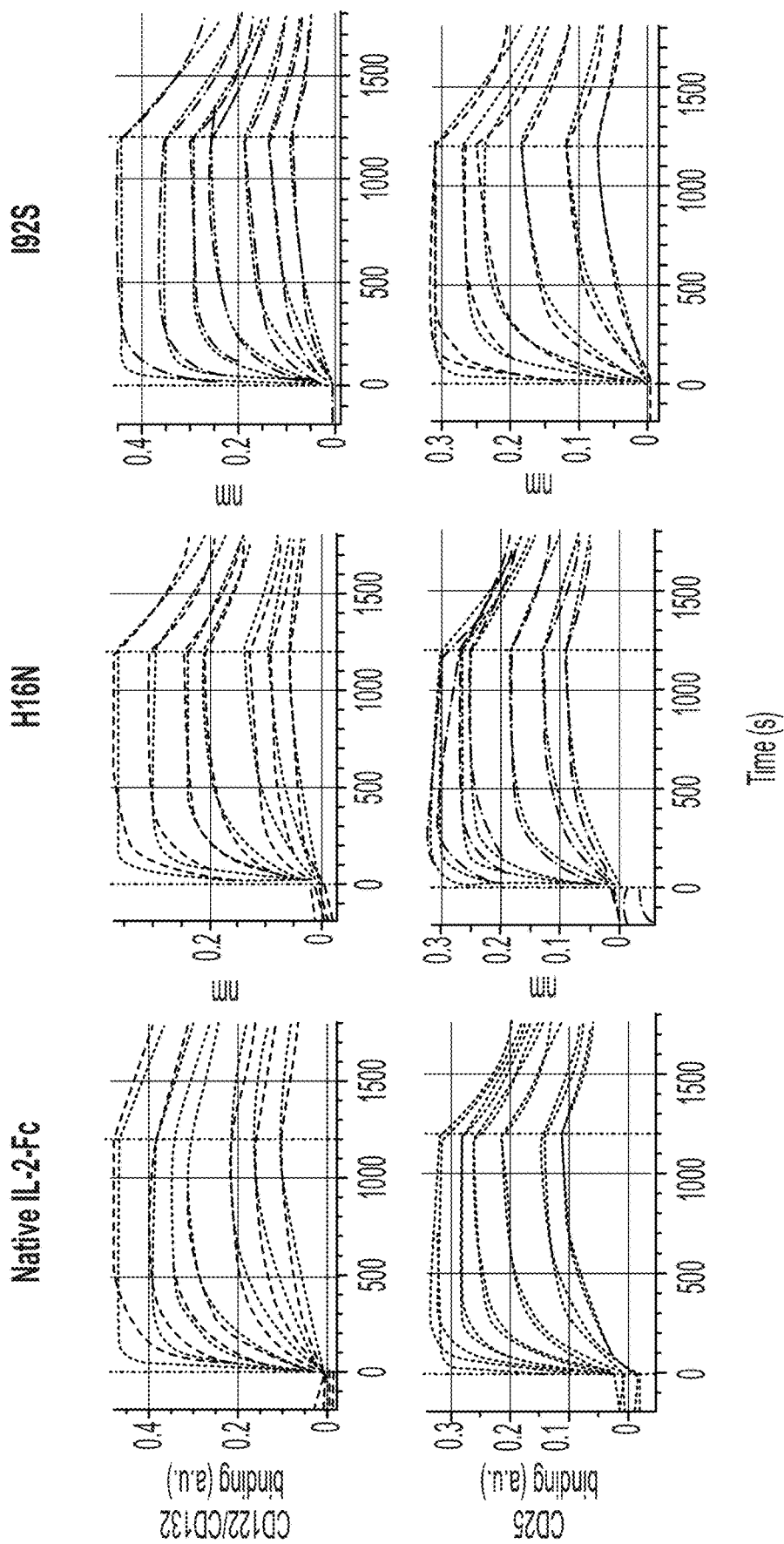
FIG. 7 provides a series of graphs depicting the affinity of IL-2-Fc fusion proteins comprising different IL-2 variants, as indicated, for CD122/CD132 Fc heterodimer and extracellular domain of CD25 measured on an Octet biolayer interferometry instrument. IL-2 variants contain V69A/Q74P plus the indicated mutations. IL-2-Fc fusion proteins were immobilized on anti-human Fc capture tips and then incubated with a concentration range of indicate IL-2 receptor. Association and dissociation phase kinetics used to estimate binding affinity. Excess amount of an irrelevant antibody was used to prevent non-specific binding or capture of the CD122/CD132 Fc protein by the tips.
Figure 7:
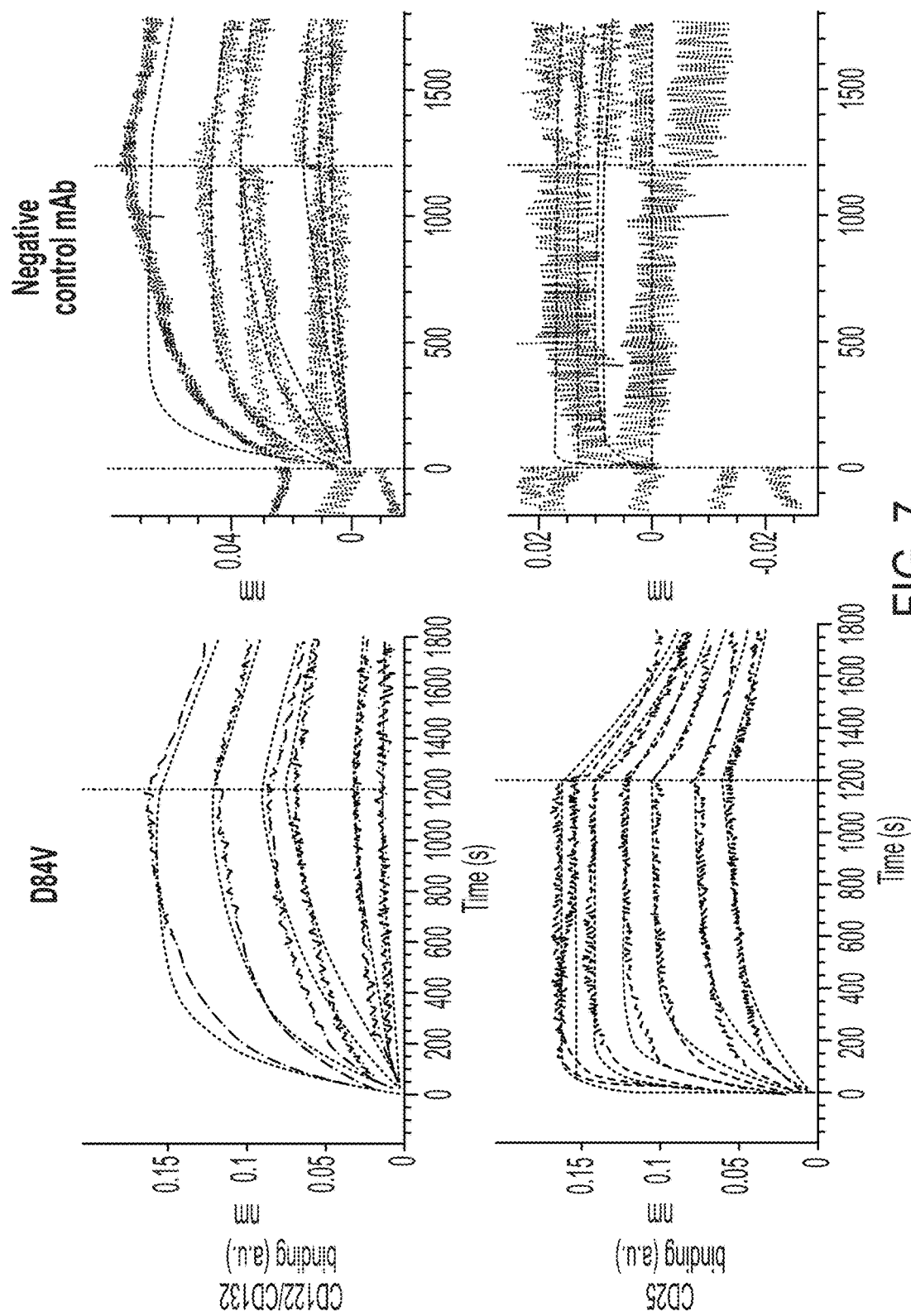

Several of these IL-2 sequences, along with additional sequences identified from sequences not tested individually in the yeast display format, were transferred into plasmids for expression and purification as Fc fusion proteins as in Example 1. Specifically, the indicated mutation(s) was introduced into the base sequence of IL-2 V69A/Q74P/C125S (SEQ ID NO: 2), fused at its C-terminus to a 20-amino acid linker comprising the sequence $(G_4S)_4$ (SEQ ID NO: 48) followed by IgG1 Fc fragment containing N297G mutation (SEQ ID NO: 40). An Octet instrument (Molecular Devices, LLC) was used to determine affinity for CD122/CD132 heterodimer in this format. Specifically, IL-2-Fc fusion proteins were captured on anti-human Fc tips at optimized density, and association and dissociation rates determined across a range of concentrations of receptor. Representative data show that lower affinity was apparent when wild-type IL-2 was compared to a mutant form (FIG. 7), with observed $K_D$ values summarized in Table 3.

Additionally, the IL-2 mutein, IgG1 Fc fusion polypeptides were expressed as monomeric proteins by introducing mutations into the Fc domain that prevented their dimerization, but still allowed for purification by protein A. Additionally, an amino acid sequence was added to each molecule to allow site-specific biotinylation by the enzyme BirA. These fusions were first expressed in Expi293 cells, then purified by protein A chromatography, and were site-specifically biotinylated. An Octet instrument (Molecular Devices, LLC) and streptavidin biosensors, were used to capture the biotinylated fusions and determine the affinity for the CD122/CD132 heterodimer as well as CD25 in this format. Specifically, the CD122/CD132 knob-hole heterodimer was applied to the biosensor and association and dissociation rates were determined across a range of concentrations of receptor. Representative data with observed $K_D$ values is summarized in Table 11.

These results exemplify the generation and isolation of IL-2 muteins with a range of affinities for the intermediate-affinity dimeric CD122/CD132 IL-2 receptor.

TABLE 2

IL-2 $K_D$ for CD122/CD132 Fc heterodimer and CD25 extracellular domain measured in yeast surface display

| Mutations (all contain V69A/Q74P) | CD122/CD132 KD (nM) | CD25 KD (pM) |
|---|---|---|
| None | 1.7 | 90 |
| I28T | 7.0 | Not tested |
| H16D | 11.2 | 71 |
| H16L | 12.9 | 58 |
| H16N | 4.2 | 78 |
| N88L | 71 | 25 |
| N88S | 10.0 | Not tested |
| Also tested with minimal effect observed | | |
| I28F | 1.7 | 50 |
| E67K | 2.8 | 85 |
| R81F | 1.1 | 58 |
| N90T | 1.7 | 60 |
| N90H | 1.9 | 81 |
| E110Y | 1.7 | 42 |
| E110K | 1.9 | 61 |
| E116T | 2.0 | 64 |
| E116A | 1.5 | 51 |
| Q126T | 1.9 | 98 |
| Q126R | 2.0 | 92 |
| Q126K | 2.2 | 109 |
| Y31D | 1.4 | 43 |
| T37W | 1.1 | 41 |
| T102G | 1.4 | 47 |
| F103D | 1.2 | 44 |
| A108Q | 1.2 | 49 |
| T111A | 1.1 | 60 |
| I114V | 1.3 | 43 |

TABLE 3

Selected IL-2-Fc fusion protein, $K_D$ for CD122/CD132 Fc heterodimer and CD25 extracellular domain measured by Octet binding

| Mutations (all contain V69A/Q74P) | CD122/CD132 KD (nM) | CD25 KD (nM) |
|---|---|---|
| None | 3.9 | 1.0 |
| H16N | 8.7 | 0.8 |
| I92S | 12.9 | 0.6 |
| D84V | 21.1 | 0.6 |
| Q126R | 2.4 | 0.6 |
| P34T | 2.7 | 0.8 |
| D109N | 2.5 | 0.7 |
| S87R | 9.5 | 0.9 |
| R120G | 5.9 | 1.0 |
| I24L | 5.4 | 0.8 |
| T101R | 3.7 | 0.8 |
| T41K | 2.4 | 0.5 |
| N88S | 21.5 | 0.9 |
| F42A, Y45A, L72G, N88D (negative control) | 66.4 | Not detected |
| R38A, F42K, N88D (negative control) | 79.6 | Not detected |

TABLE 11

Selected IL-2-Fc fusion protein, fusion location, $K_D$ for CD25 extracellular domain and CD122/CD132 Fc heterodimer measured by Octet binding

| Mutations | IL-2 Fusion location | CD25 $K_D$ (nM) | CD122/CD132 $K_D$ (nM) |
|---|---|---|---|
| None | N-terminus | 0.19 | 5.30 |
| None | C-terminus | 0.54 | 3.04 |
| H16N, V69A, Q74P, C125S | N-terminus | 0.44 | 22.3 |
| H16L, V69A, Q74P, C125S | N-terminus | 0.36 | 122 |
| N88D | C-terminus | 1.01 | 24.0 |
| V91K | C-terminus | 0.69 | 7.56 |

Figure 8:
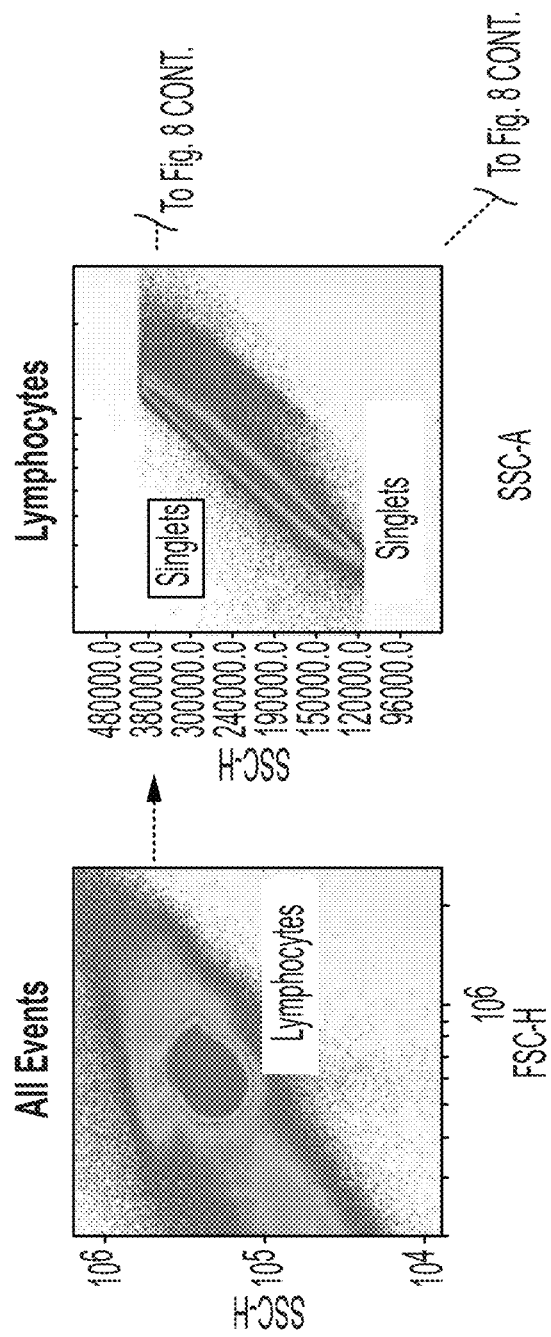
FIG. 8 provides a schematic illustrating a gating strategy and corresponding flow cytometry data to identify IL-2-sensitive cell populations from human PBMCs. Singlet lymphocytes as identified based on forward and side scatter. Populations are defined as: T regulatory cells (CD4+ CD25$^{high}$Foxp3+), CD25$^{high}$ T helper cells (CD4+ CD25$^{high}$Foxp3−) and natural killer cells (CD3−CD56+).
Figure 8:
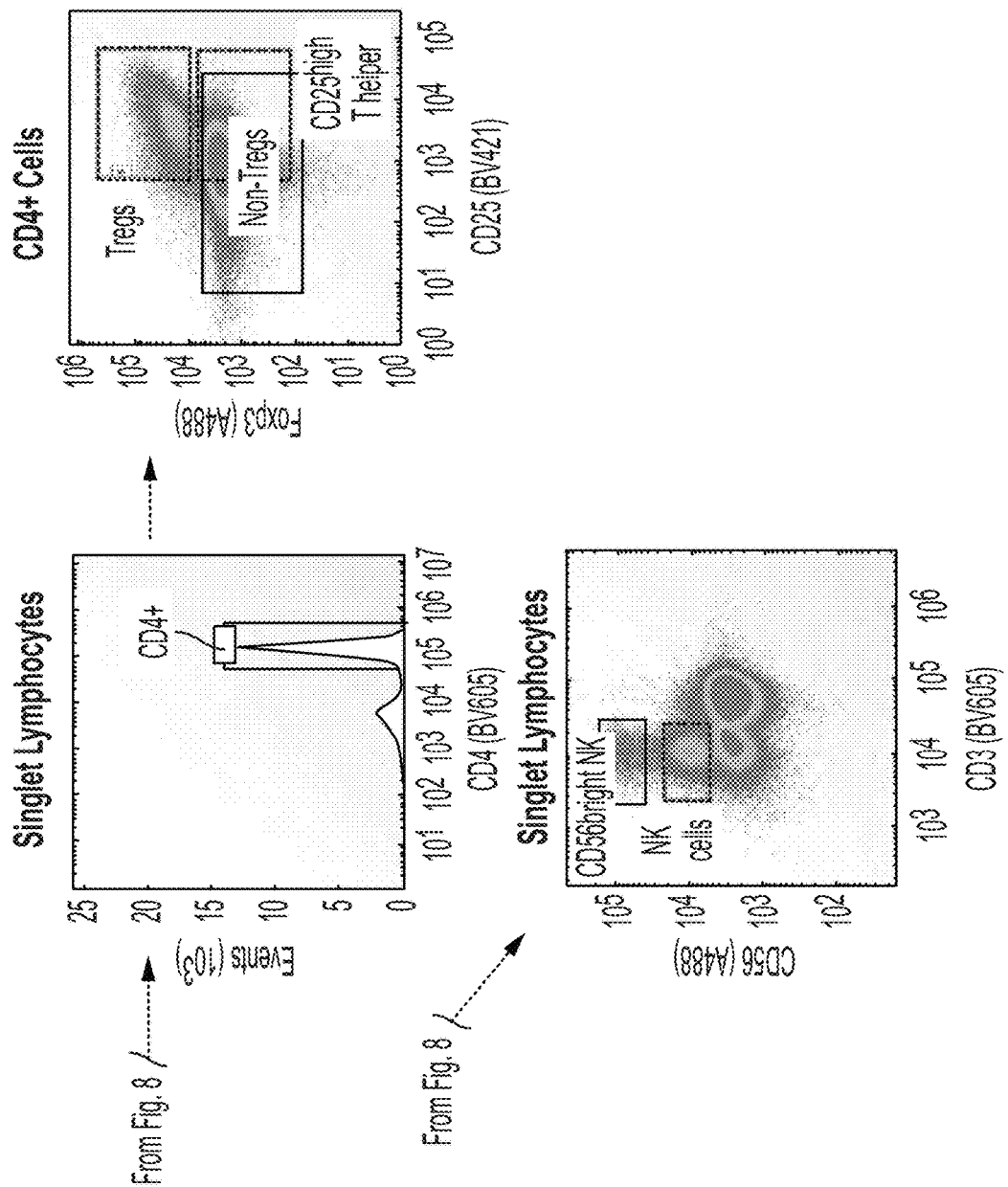

Example 3: IL-2-Fc Fusion Proteins with Reduced CD122/CD132 Receptor Affinity Specifically Activate CD25+Foxp3+T Regulatory Cells The ability of IL2-Fc fusion proteins with altered IL-2 receptor affinity to specifically activate Treg cells was evaluated. Briefly, the ability of exemplary IL-2-Fc fusion proteins with mutations that reduce CD122/CD132 receptor affinity (H16N, H16L, I92S, D84V and S87R) to induce IL-2 signaling in CD25+Foxp3+T regulatory cells was compared to induction of signaling in CD25$^{High}$Foxp3− T helper cells (defined as CD4+CD25$^{High}$Foxp3− lymphocytes) and in natural killer cells (NK cells, defined as CD3-CD56+ lymphocytes) using a flow cytometry-based pSTAT5 assay described further below (FIG. 8). Linker and Fc regions comprising the IL2-Fc fusion proteins in this Example were as described in Example 2. The CD25+T helper cells are measured in this assay because they represent the most likely unintended target of an IL-2-based therapeutic intended to treat diseases or disorders involving aberrant immune activation. The parent IL-2-Fc fusion protein (SEQ ID NO: 2), that does not contain a mutation known to affect IL-2 receptor affinity and a similar molecule in clinical trials (an irrelevant antibody with IL-2 fused to its C-terminus and containing the N88D mutation in IL-2 (C-term N88D, as described as IgG-(IL-2N88D)$_2$ in Peterson et al. Journal of Autoimmunity (2018) 95: 1-14) were used as comparators.

Frozen human PBMCs (ATCC) were thawed and divided into 96-well plates. After resting 2 hours cells were treated for 30 minutes with a range of concentrations of the IL-2-Fc fusion proteins, native IL-2, or comparator molecule. After treatment, the cells were fixed with formaldehyde to "pause" their signaling processes, then treated with cold methanol to remove their plasma membrane. Cells were then stained with fluorescent antibodies that recognize markers of cell identity. For example, T regulatory cells are CD4+ CD25$^{high}$Foxp3+, IL-2 responsive non-T regulatory cells are CD4+CD25$^{high}$Foxp3−, and NK cells are CD3-CD56+). The cells were also stained with an antibody (Cell Signaling Technology Cat #9365 and #14603) that binds to the transcription factor STAT5 phosphorylated at tyrosine 647 (pSTAT5). pSTAT5 is produced as a direct result of IL-2 signaling by receptors on the cell surface, making it a suitable marker for IL-2 signaling. Flow cytometry was used to measure markers of cell identity (FIG. 8), along with the level of pSTAT5. The concentration of IL-2-Fc fusion protein that causes each cell population to reach 50% of its maximum signaling output (the EC$_{50}$) was determined, as well as the maximum signaling output that could be obtained. For analysis purposes, maximum signaling output is normalized to the maximum signaling obtained using IL-2-Fc protein containing only V69A/Q74P mutations in the IL-2.

FIGS. 9A, 9B, 9C, and 9D show the level pSTAT5 signaling in CD25+ Treg cells and CD25+ non-Treg cells, NK cells, and CD8+ cytotoxic T cells, respectively, following incubation with a range of concentrations of the IL-2-Fc fusion proteins, as indicated. As expected, all the mutant IL-2-Fc molecules have reduced potency in activating signaling compared to the wild-type molecule containing only V69A/Q74P. They all show increased specificity for Tregs when compared to the wild-type molecule (in CD25$^{high}$ T helper cells, NK cells, and the CD8+ cytotoxic T cells, the EC50 shifts farther than in Tregs, the maximum activation decreases more than Tregs, and/or signaling in the non-T reg populations because unmeasurable). Further, the C-term N88D IL-2-Fc fusion protein shows lower induction of pSTAT5 signaling in Tregs than do all the IL-2-Fc fusion proteins tested (except for the negative control molecule). The C-term N88D has no detectable signaling on the non-T reg cell types so relative specificity could not be determined (FIG. 8 and Table 4).

These results demonstrate that specific mutations that reduce CD122/CD132 receptor affinity (e.g., H16N, H16L, I92S, D84V, S87R) in a human IL-2 polypeptide comprising an IL-2-Fc fusion protein increase its ability to specifically activate T regulatory cells relative to CD25$^{high}$ T helper cells and NK cells, measured by a combination of EC$_{50}$ and maximum activation, with different muteins displaying a variety of behaviors in each respect. Further, these data demonstrate that some IL-2-Fc fusion proteins tested as described above have a greater ability to activate T regulatory cells than the comparator molecule C-term N88D molecule.

that moderately reduce affinity to CD25 to increase specific activation of Tregs has not been explored. We used data from yeast surface display experiments in Examples 1 and 2 to identify amino acid positions that are permissive to mutation, then compared those positions to residues that contact CD25 in a published structure of the IL-2/CD25 complex (Stauber et al. Proc Natl Acad Sci USA (2006) 103(8):2788-2793). In particular, IL-2 residues K35, R38, F42, and E68 make contact with the CD25 and permit mutations. Existing mutations have targeted R38, F42 and E68 to eliminate CD25 affinity (Carmenate et al. J Immunol (2013) 190(12): 6230-6238, and a K35 mutation has been reported to improve IL-2 stability (Rojas et al. Scientific Reports (2019) 9:800).

A series of IL-2-Fc fusion proteins were generated containing mutations at these positions. Specifically, the indicated mutation(s) was introduced into the base sequence of IL-2 V69A/Q74P (SEQ ID NO: 2), fused at its C-terminus to a 20-amino acid linker comprising the sequence (G$_4$S)$_4$ (SEQ ID NO: 48) followed by IgG1 Fc fragment containing N297G mutation (SEQ ID NO: 40). Specific mutations tested were K35E, R38Q, R38N, R38E, F42Q, F42K, E68N and E68Q. IL-2 signaling activity of these exemplary IL-2-Fc fusion proteins in Tregs, CD25$^{high}$ T helper cells and NK cells in human PBMCs was determined as in Example 4. The parent IL-2-Fc fusion protein (SEQ ID NO: 2) that does not contain a mutation known to affect IL-2 receptor affinity, was used as a comparator. E68N and E68Q were indistinguishable from wild type in this assay and are not included below.

Figures 10A, 10B, 10C:
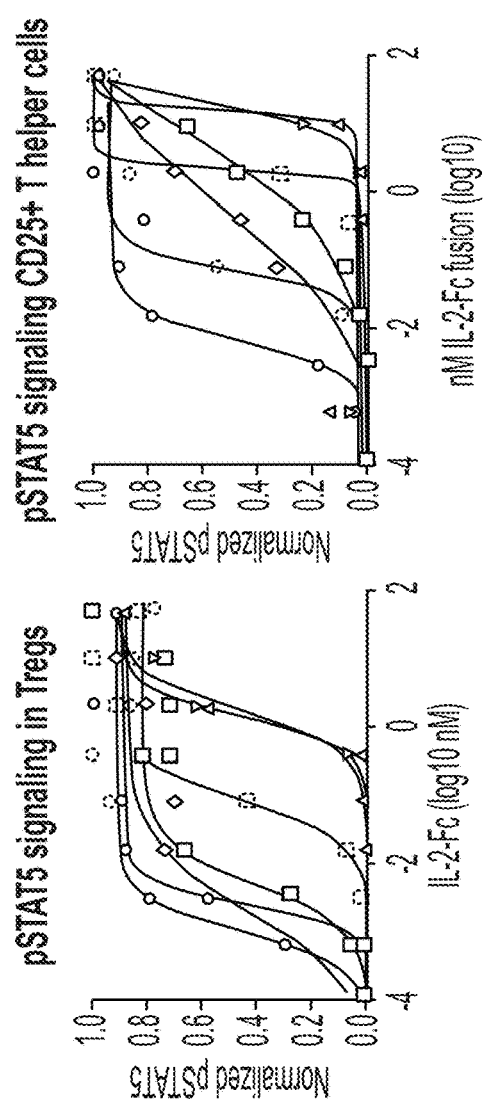
FIGS. 10A-10C provide graphs depicting the IL-2 signaling response in IL-2-sensitive cells populations (FIG. 10A, Tregs.

FIGS. 10A, 10B, and 10C show the level pSTAT5 signaling in Treg cells, CD25$^{high}$ T helper cells, and NK cells, respectively, following incubation with a range of concentrations of the IL-2-Fc fusion proteins, as indicated. Table 5

TABLE 4

Signaling potency (EC$_{50}$ and maximum activation) of IL-2-Fc fusion proteins on Tregs, CD25$^{high}$ T helper cells and NK cells in human PBMCs

| IL-2-Fc Fusion Protein | IL-2 Variant SEQ ID NO | Treg EC$_{50}$ (nM) | Treg Max. Signal | CD25$^{high}$ T helper EC$_{50}$ (nM) | CD25$^{high}$ T helper Max. Signal | NK cells EC$_{50}$ (nM) | NK cells Max. Signal |
|---|---|---|---|---|---|---|---|
| V69A/Q74P | 2 | 0.001 | 1 | 0.007 | 1 | 2.6 | 1 |
| H16N/V69A/Q74P | 4 | 0.003 | 0.82 | >50 | ~0.5 | >50 | N.D. |
| H16L/V69A/Q74P | 5 | 0.238 | 1.22 | 0.827 | 0.29 | N.D. | N.D. |
| I92S/V69A/Q74P | 11 | 0.009 | 0.78 | N.D. | N.D. | N.D. | N.D. |
| D84V/V69A/Q74P | 7 | 0.013 | 1.20 | N.D. | N.D. | N.D. | N.D. |
| S87R/V69A/Q74P | 8 | 0.002 | ~1 | ~1 | ~1 | 10.2 | 0.83 |
| Inactive IL-2 | 30 | N.D. | N.D. | N.D. | N.D. | N.D. | N.D. |
| C-term N88D | NA | 0.37 | 0.50 | N.D. | N.D. | N.D. | N.D. |

EC$_{50}$ and maximum pSTAT5 signal induced by the indicated IL-2-Fc fusion for each cell type after 30 minutes as measured in human PBMCs. Values are determined by curve fitting to data in FIG. 8. Values indicated with ~ are visual estimates due to poorly converged estimates from fitting. N.D. indicates that meaningful pSTAT5 was not detected.

Example 4: IL2-Fc Fusion Proteins with Moderate Affinity for CD25 Have Enhanced Specificity for Tregs Compared to Other CD25$^{high}$ T Cells Previous work has developed IL-2 muteins with greatly reduced affinity for CD25 because such molecules may be useful in the context of treating cancer (Levin et al. Nature (2012) 484:529-533). Other work has aimed to increase the affinity for CD25 based on the hypothesis that this may increase activity toward Tregs relative to other cell types, which may be useful for treating diseases involving aberrant activity of the immune system. The ability of IL-2 mutations shows the EC$_{50}$ for Tregs vs CD25$^{high}$ T helper cells, along with the specificity (calculated as the ratio of CD25$^{high}$ T helper EC$_{50}$ divided by Treg EC$_K$). As expected, reducing the affinity for CD25 also reduced signaling in Tregs and CD25$^{high}$ T helper cells, but had little or no impact on NK cells (which do not express CD25). In a result that was consistent with our hypothesis but unexpected given prior art, reducing affinity for CD25 also increased specificity for Tregs over the CD25$^{high}$ T helper cells. This was especially pronounced for R38N and K35E mutations, but the effect occurs across all the mutein tested.

TABLE 5

Signaling potency and specificity toward T regulatory of IL-2-Fc fusion proteins with reduced affinity for CD25

| IL-2-Fc Fusion Protein | IL-2 Variant SEQ ID NO | CD25 $K_D$ (nM yeast display) | Treg EC$_{50}$ (nM) | CD25$^{high}$ T helper EC$_{50}$ (nM) | Ratio |
|---|---|---|---|---|---|
| V69A/Q74P | 2 | 0.27 | 0.001 | 0.0007 | 7.1 |
| R38Q/V69A/Q74P | 17 | 1.47 | 0.0025 | 0.0071 | 28.4 |
| R38N/V69A/Q74P | 22 | 1.82 | 0.0049 | 13.8 | 2822 |
| R38E/V69A/Q74P | 27 | N.D. | 1.717 | 15.5 | 9.0 |
| F42Q/V69A/Q74P | 29 | N.D. | 0.087 | 2.25 | 25.9 |
| F42K/V69A/Q74P | 28 | N.D. | 1.381 | 22.0 | 15.9 |
| K35E/V69A/Q74P | 12 | 0.78 | 0.002 | 0.60 | 300 |

IL-2 muteins at the interface with CD25 tested for binding to CD25 in a yeast display titration assay, and for signaling potency in human PBMCs by measuring pSTAT5 levels after 30 minutes in T regulatory cells (CD4 + CD25$^{high}$Foxp3+) and CD25$^{high}$ T helper cells (CD4 + CD25$^{high}$Foxp3−).
Signaling potency determined by fitting to the titrations shown in FIG. 9.
N.D. - binding not detected These results demonstrate that specific mutations that reduce CD25 receptor affinity (e.g., R38Q, R38N, R38E, F42Q, F42K, K35E) in a human IL-2 polypeptide comprising an IL-2-Fc fusion protein increases the ability to specifically activate T regulatory cells relative to other CD25$^{high}$ T cells. Further, these results demonstrate that the amino acid residue selected for substitution at a certain position within the IL-2 polypeptide (e.g., R38Q, R38N, R38E) comprising an IL-2-Fc fusion protein differentially affects the extent of T regulatory cell activation and selectivity. There is a window where reduced CD25 affinity leads to greatly increased selectivity for Tregs over other CD25$^{high}$ T cells. In the assay presented here, that window begins at roughly 50% decrease in potency toward Tregs (2× baseline EC$_{50}$), with a maximum around 80% decreased potency (5× baseline EC$_{50}$). The additional selectivity decreases by the point of 87× decreased potency toward Tregs. Because selective activation of Tregs over other T cells is believed to be useful for therapeutic benefit in treating many immune disorders, mutations at these positions are likely to impart useful properties on a clinical molecule.

Example 5: IL-2-Fc Fusion Proteins with Mutations Affecting Binding to Both CD122/CD132 and CD25 Maintain Specificity for T Regulatory Cells Over CD25$^{high}$ T Cells and NK Cells Because mutations affecting binding to CD122/CD132 dimer provide specificity for Tregs over NK cells and non-Treg T cells, and CD25 mutations independently provide specificity Tregs over CD25$^{high}$ T helper cells, combination mutations may have novel combinations of specificity and potency that would be useful in an immune-modulatory therapeutic. We produced IL-2-Fc fusion proteins as in Examples 1, 3 and 4 and tested their ability to signal in pSTAT5 assays using human PBMCs as in Examples 3 and 4.

Figure 11A:
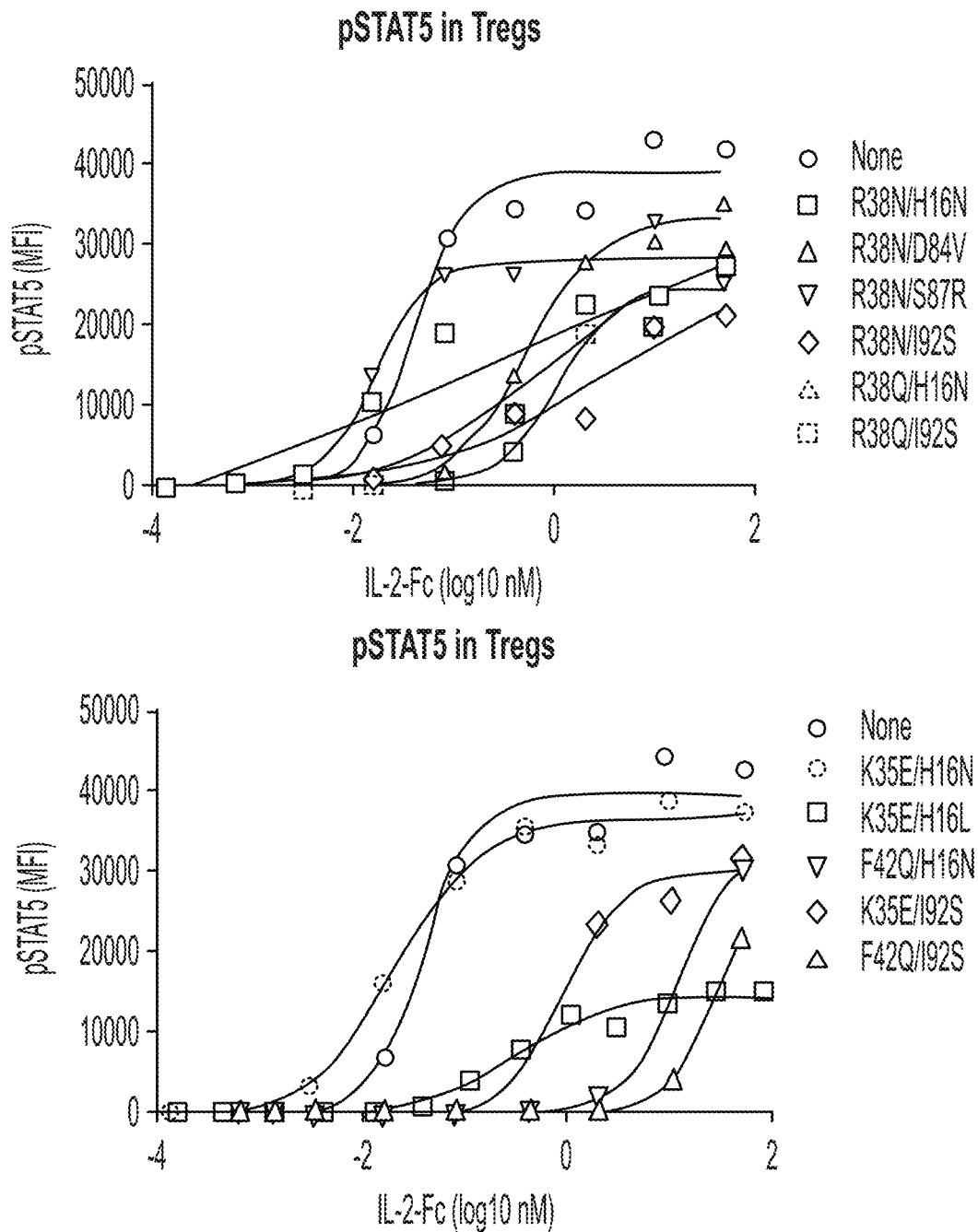
FIGS. 11A-11C provide graphs depicting the IL-2 signaling response in IL-2-sensitive cells populations (FIG. 11A, Tregs.
Figure 11B:
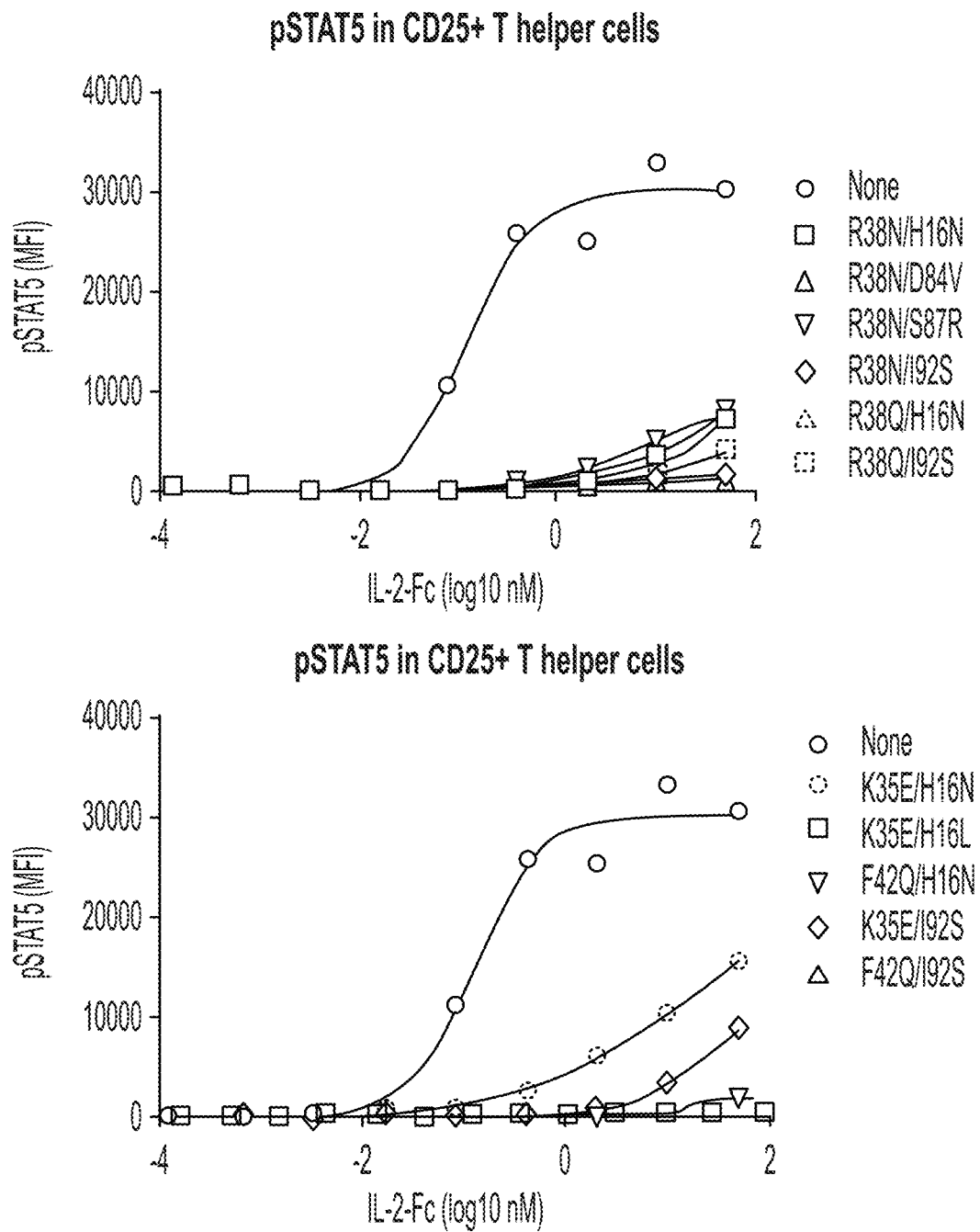
Figure 11C:
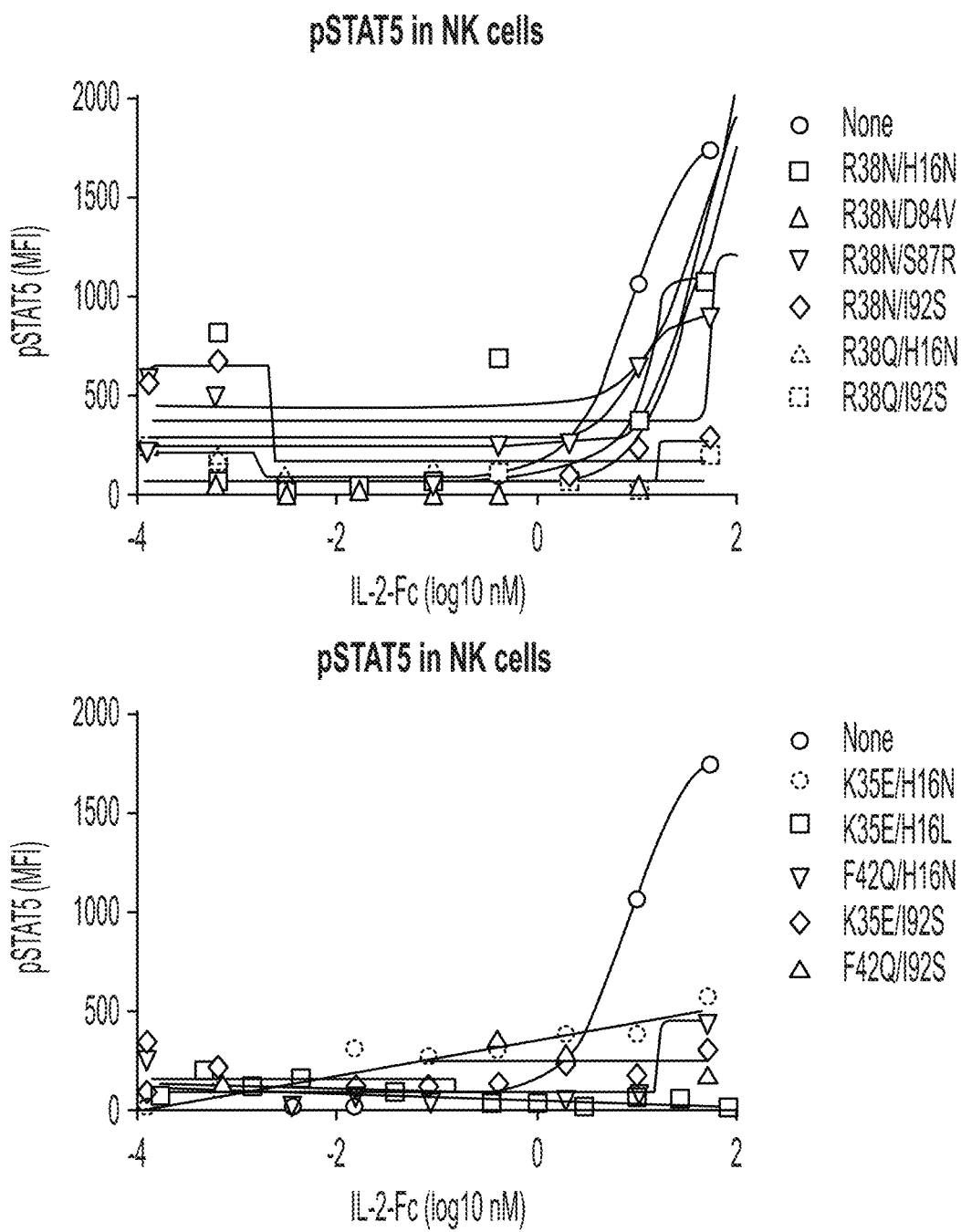

FIGS. 11A, 11B, and 11C show the level pSTAT5 signaling in Treg cells, CD25$^{high}$ T helper cells, and NK cells, respectively, following incubation with a range of concentrations of indicated IL-2-Fc fusion proteins (muteins containing R38E are not shown because they have low potency on Tregs, see Table 6). All data shown here use PBMCs from a single human donor, but it is not the same donor as shown in earlier examples. Data are split between a top and bottom panel so that individual curves are visible. The control IL-2-Fc fusion containing only V69A/Q74P mutations is shown in every panel. Importantly, all combination muteins retain the ability to activate IL-2 signaling in Treg cells, with potency on Tregs spanning approximately 3 orders of magnitudes. Relative specificity against CD25$^{high}$ T helper cells and NK cells could not be determined because most muteins did not generate enough pSTAT5 at any concentration to be assayed reliably. The fact that potency on Tregs is still easily detectable but pSTAT5 signaling on other cell types is barely detectable indicates that combinations of mutations targeting the interactions with CD122/CD132 and with CD25 largely retain their selectivity toward Tregs.

TABLE 6

Potency on Tregs (EC$_{50}$) of IL-2-Fc fusion proteins containing combinations of mutations targeting the interfaces with CD25 and CD122/CD132

| IL-2-Fc Fusion Protein (all contain V69A/Q74P/C125S) | IL-2 Variant SEQ ID NO | Treg EC$_{50}$ (nM) |
|---|---|---|
| None | 2 | 0.039 |
| K35E/H16N | 13 | 0.022 |
| K35E/I92S | 16 | 0.93 |
| K35E/R38N/H16N | 38 | 9.8 |
| R38N/H16N | 23 | 0.18 |
| R38N/D84V | 25 | 0.76 |
| R38N/S87R | 31 | 0.017 |
| R38N/I92S | 26 | 3.2 |
| R38Q/H16N | 18 | 0.55 |
| R38Q/I92S | 21 | 1.0 |
| R38E/H16N | 32 | 49 |
| R38E/D84V | 33 | 65 |
| R38E/S87R | 34 | 39 |
| R38E/I92S | 35 | 207 |
| F42Q/H16N | 36 | 13 |
| F42Q/I92S | 37 | 37 |

Example 6: Flexible, Helical and Rigid Linkers Minimally Affect Function and Stability of IL-2-Fc Fusions The functional properties of some fusion proteins, their expression levels and thermal stability have been shown to be improved with the incorporation of Pro-rich linkers and helical linkers that are more rigid than the (G$_4$S)$_X$ (SEQ ID NO: 1029) flexible linker (Zhao et al., Protein Expr Purif (2008) 61: 73-77)).

To test if the rigidity and increased length of the linker can improve the thermal stability and signaling activity of the IL-2 muteins while still retaining their specificity for activating regulatory T cells, Fc fusion proteins containing stabilized IL-2 (V69A/Q74P mutein) and IL-2 containing a mutation that reduces affinity for CD122 (V69A/Q74P/H16N) with 8 different linkers (IL2-Li-Fc, Table 7) were designed and expressed. Linkers tested have one or more of several characteristics. Some linkers are Proline rich and incorporate N-glycosylation sites that add to the rigidity of the linker peptides. Other linkers tested are α-helical rigid linkers (Arai et al., *Protein Eng* (2001) 14(8): 529-532). Some of the other linkers are naturally occurring linkers found in multiple domain proteins and some are Proline rich artificially designed sequences.

Some of the IL-2-Li-Fc fusion proteins with the new linkers exhibit slightly improved thermal stability compared to the IL-2-(G$_4$S)$_4$Fc linker ("(G$_4$S)$_4$" disclosed as SEQ ID NO: 48) in a Differential Scanning Fluorimetry (DSF) assay with the fluorescent protein-dye SYPRO orange (Table 7).

To evaluate the effect of different linkers on the biological activity of the IL-2-Li-Fc fusion protein, pSTAT5 signaling assay described in earlier examples was used. The pSTAT5 assay was used to assess the effect of linkers on the selectivity and activity of IL-2-Li-Fc fusion proteins in the context of a stabilized IL-2 (containing V69A/Q74P/C125S) and stabilized IL-2 including the H16N mutation that confers selectivity toward Tregs. Comparison of the EC50s of IL-2-Li-Fc fusion proteins with different linkers shows that most linkers were similar to or slightly more active than IL-2-Fc fusions with $(G_4S)_4$ linker (SEQ ID NO: 48) (Table 8). Some linkers showed notably lower activity (v5 and v7 with H16N mutation).

TABLE 7

Amino acid sequence of linkers tested (Li) and melting temperature of the IL-2-Fc in wild-type (WT, contains V69A/Q74 mutations) and H16N formats (V69A/Q74P/H16N)

| Description | Sequence | SEQ ID NO | Tm (WT) | Tm (H16N) |
|---|---|---|---|---|
| Linker v1 | AGSGGSGGSGGSPVPSTPPTNSSSTP PTPSPSASGS | 49 | 48.8 | 49 |
| Linker v2 | AGSGGSGGSGGSPVPSTPPTPSPSTP PTPSPSGGSGNSSGSGGS | 50 | 48.5 | 49.5 |
| Linker v3 | AGSGNSSGSGGSGGSGNSSGSGGSPV PSTPPTPSPSTPPTPSPSASGS | 51 | 49.3 | 50.4 |
| Linker v4 | AEAAAKEAAAKEAAAKEAAAKAGS | 52 | 48.4 | 48.8 |
| Linker v5 | GTTPNPPASSSTTGSSTPTNPPAGS | 53 | 48.2 | 49.3 |
| Linker v6 | AGSPGAGNGGNNGGNPPPPTTTTSSA PATTTTASAGS | 54 | 48.4 | 48.8 |
| Linker v7 | GGGSAGGGSAGGGSAGGGSAGS | 55 | 47.9 | 45.5 |
| $(G_4S)_4$ (SEQ ID NO: 48) | GGGGSGGGGSGGGGSGGGGS | 48 | 46.5 | 45.7 |

TABLE 8

Signaling potency determined by pSTAT5 signaling assay with human PBMCs for of IL-2-Fc proteins with various linkers on Tregs, CD25$^{high}$ T helper cells and NK

| IL-2 variant (linker) | Tregs CD4+ CD25$^{High}$FoxP3+ EC50 (nM) | T Helper CD4+ CD25$^{High}$ FoxP3− EC50 (nM) | NK cells CD3− CD56+ EC50 (nM) |
|---|---|---|---|
| H16N (v1) | 0.003 | 0.113 | Not detected |
| H16N (v2) | 0.003 | 0.090 | Not detected |
| H16N (v3) | 0.009 | 0.101 | Not detected |
| H16N (v4) | 0.005 | 0.243 | 13.5 |
| H16N (v5) | 0.052 | 2.6 | Not detected |
| H16N (v6) | 0.011 | 0.96 | Not detected |
| H16N (v7) | 0.026 | 2.68 | Not detected |
| H16N $(G_4S)_4$ (SEQ ID NO: 48) | 0.008 | 1.04 | 6.1 |
| WT (v1) | 0.003 | 0.008 | 2.6 |
| WT (v2) | 0.004 | 0.007 | 1.7 |
| WT (v3) | 0.007 | 0.016 | 2.0 |
| WT (v4) | 0.003 | 0.005 | 1.0 |
| WT (v5) | 0.022 | 0.101 | 7.6 |
| WT (v6) | 0.012 | 0.046 | 8.2 |
| WT (v7) | 0.014 | 0.068 | 10.4 |
| WT $(G_4S)_4$ (SEQ ID NO: 48) | 0.006 | 0.009 | 2.0 |

Example 7: IL-2-Fc Fusion Proteins with Reduced CD122 Receptor Affinity Specifically Expands T Regulatory Cells In Vivo The ability of IL2-Fc fusion proteins with altered IL-2 receptor affinity to specifically activate T regulatory cells in mice was evaluated. Briefly, Tg32 mice (Jackson Labs, Bar Harbor Me., stock #014565) expressing human FcRn were injected once via tail vein injection once with a range of doses (0.5 µg to 15 µg) of the H16N fusion protein comprising the 20aa GS linker $(G_4S)_4$ (SEQ ID NO: 48) fused to the N-terminus of IgG1 Fc with an N297G mutation. Control mice were treated with an equimolar amount (1 µg to 30 µg) of the C-term N88D fusion protein. Lymphocyte levels were determined by flow cytometry prior to dosing, then at 3, 5- and 7-days post-injection. To determine the in vivo effect(s) of the IL-2-Fc fusion proteins several key parameters were measured: T cells as a fraction of total lymphocytes, Foxp3+ Tregs as a fraction of T cells, CD4+T helper cells (excluding Tregs) as a fraction of T cells, CD8+ T cells as a fraction of T cells, and natural killer (NK) cells as a fraction of total lymphocytes. Specifically, total lymphocytes were defined as viable CD45+ cells, T cells as viable CD45+CD3+, Tregs as viable CD45+CD3+CD4+CD25$^{high}$CD127− cells, T helper as viable CD45+CD3+CD4+ not CD25$^{high}$ and CD127−, CD8+ T cells as viable CD45+CD3+CD8+ cells, and NK cells as viable CD45+CD3−NK1.1+.

Figures 12A, 12B, 12C:
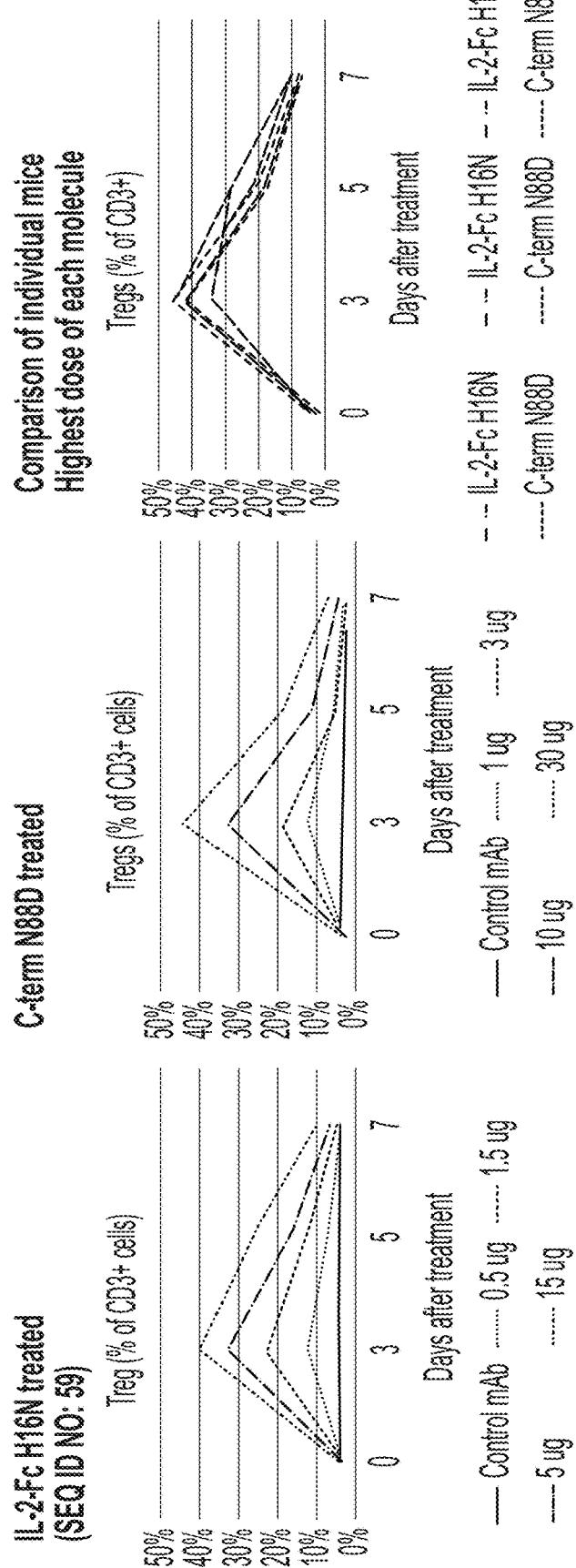
FIGS. 12A-12C provide graphs illustrating the expansion of Tregs in vivo, measured as a percentage of total CD3+ T cells, in Tg32 mice treated with IL-2-Fc H16N (FIG. 12A) or C-term N88D (FIG. 12B). Homozygous Tg32 mice were dosed by tail vein injection with the indicated amount of each IL-2 Fc fusion protein (dose levels are approximately equimolar). At the indicated time-point the lymphocyte populations were profiled, with Tregs defined as CD45+ CD3+CD4+CD25$^{high}$CD127-cells. Data in FIG. 12A
Figure 13C:
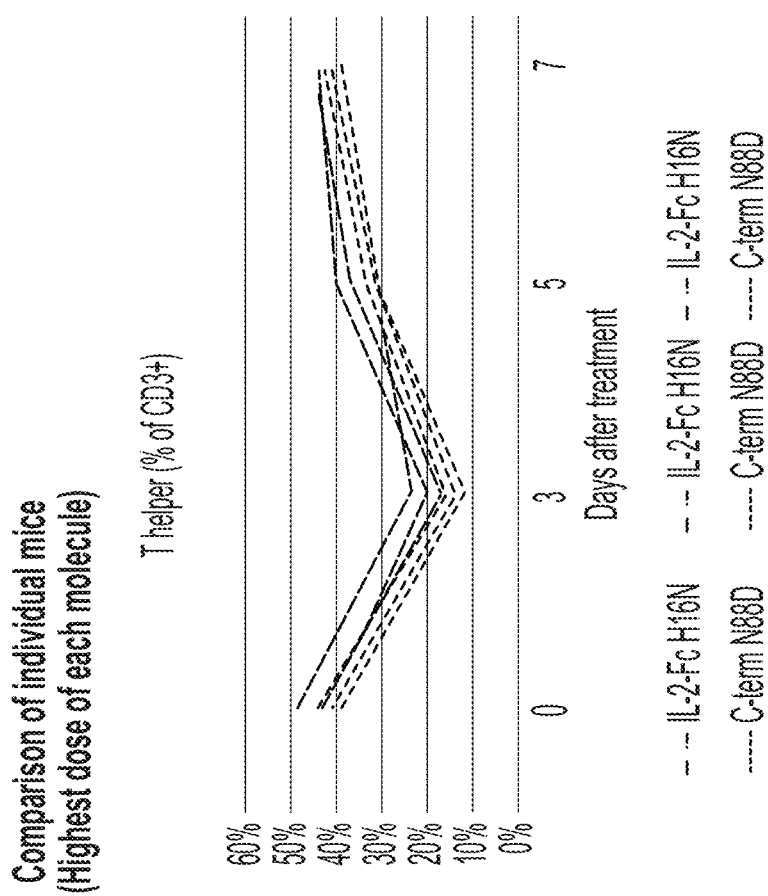
Figures 14A, 14B:
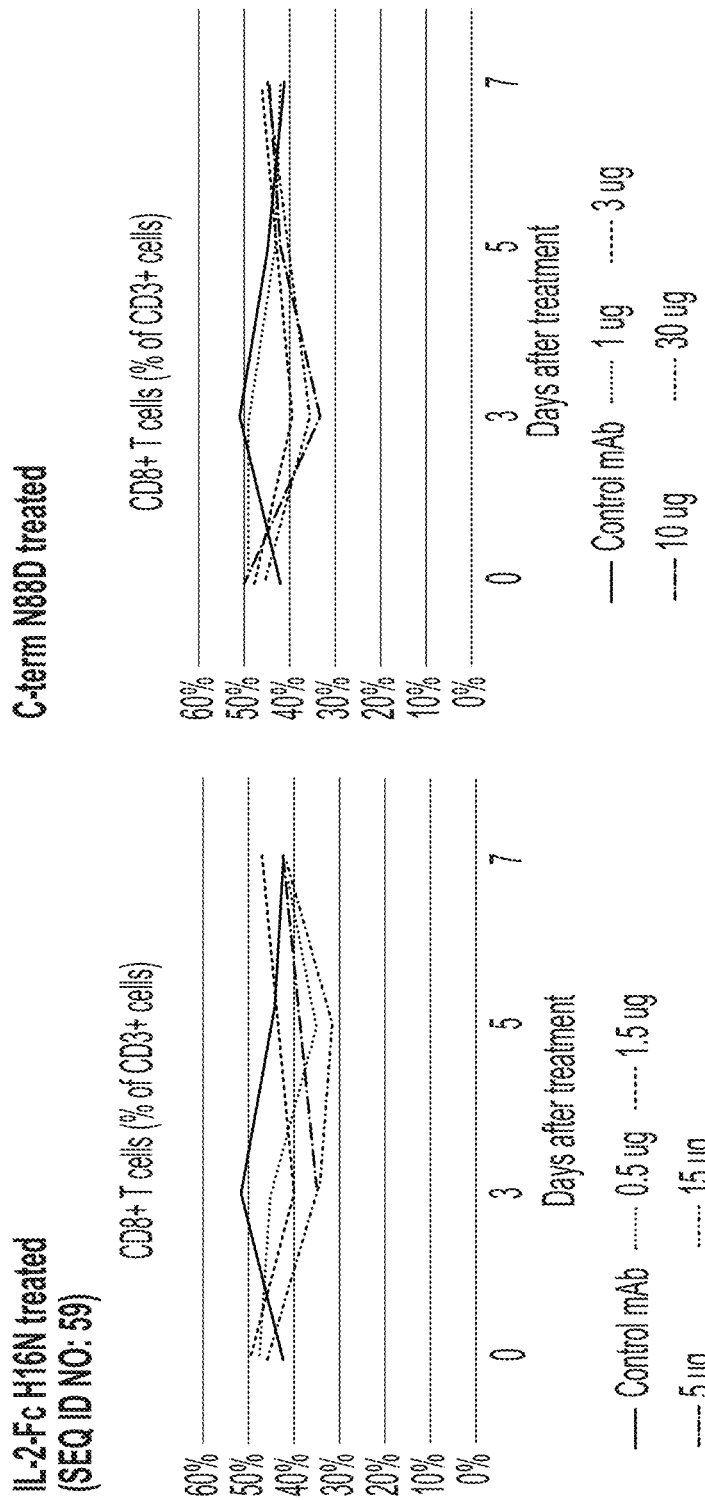
FIGS. 14A-14C provide graphs illustrating the change in the level of CD8+ cytotoxic T cells, measured as a percentage of total CD3+ T cells, in Tg32 mice treated with IL-2-Fc H16N (FIG. 14A) or C-term N88D (FIG. 14B). Mice were dosed as in FIG. 12. Cytotoxic T cells were defined as CD45+CD3+CD8+ cells. Data in FIG. 14A
Figure 14C:
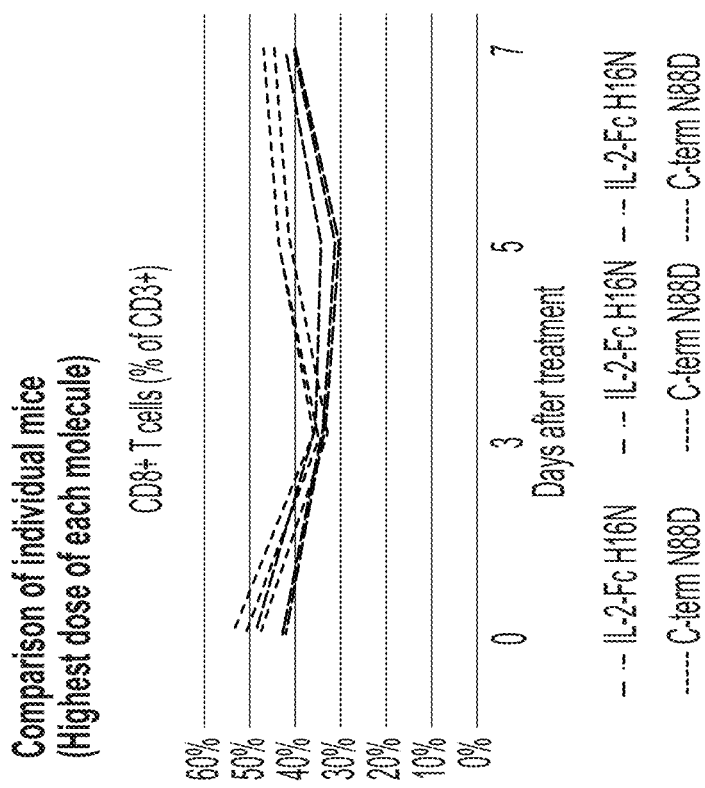

FIG. 12 shows T regs as a percentage of total T cells. Both molecules show a strong dose-dependent increase at 3 days, declining at later time-points. The response to IL-2-Fc H16N is more sustained in these mice, suggesting that this molecule exerts activity over a longer time. Data in FIG. 12A and FIG. 12B are plotted as an average of responses relative to baseline (pre-treatment values) for three mice for each dose at each time point, while FIG. 12C shows data for individual mice treated with the highest dose of each molecule. FIG. 13 and FIG. 14 show the percent of T cells that were T helper cells and CD8+ T cells respectively following treatment with each dose of IL-2-Fc fusion protein or of C-term N88D. There is a clear dose-dependent decrease after 3 days in T effectors as a fraction of the total, with the effect declining at later time-points. There is no meaningful difference between dose-matched response to the two molecules.

Figure 15C:
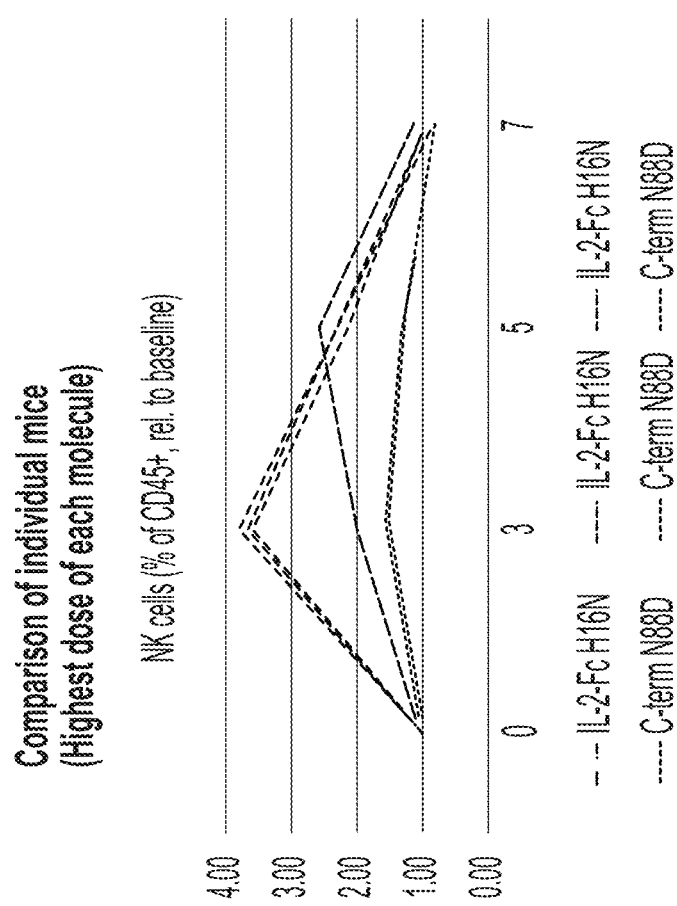

FIG. 15A and FIG. 15B show the NK cell response (NK cells/total lymphocytes) of mice treated with IL-2-Fc H16N and C-term N88D, respectively. Data are plotted as an average of NK cell percentage relative to baseline (pre-treatment values) for three mice for each dose at each time point. In mice treated with IL-2-Fc H16N, at day 3 the fraction of NK cells decreases slightly at low doses or increases slightly at high doses, in a dose-dependent manner. The effect declines at later time-points. In contrast, in mice treated with C-term N88D dose-dependent stimulation of NK cell expansion was observed to a much greater extent than in treatment with the IL-2-Fc H16N protein. NK cells as a fraction of total lymphocytes, relative to baseline, for individual mice treated with the highest dose of each molecule is shown in FIG. 15C.

Taken together, these results demonstrate that treatment of mice with IL-2-Fc H16N fusion protein induces a selective expansion of Foxp3+T regulatory cells. In contrast to the comparator molecule, IL-2-Fc H16N induces expansion of T regs over a longer period of time and induces much less expansion of NK cells in vivo.

Figure 9A:
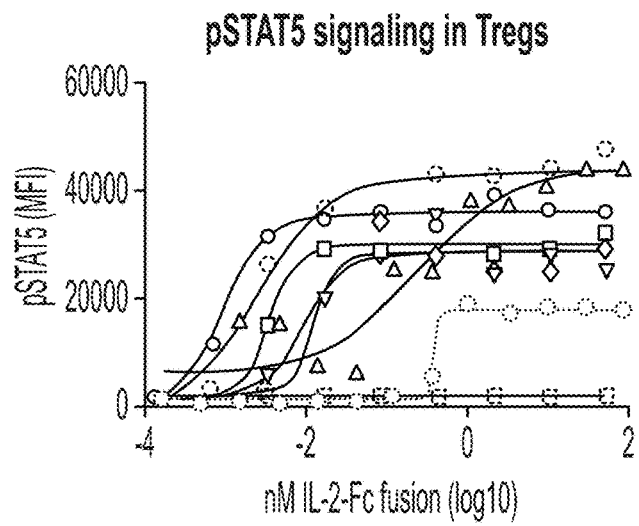
FIGS. 9A-9D provide graphs depicting the IL-2 signaling response in IL-2-sensitive cells populations (FIG. 9A, Tregs.
Figure 9B:
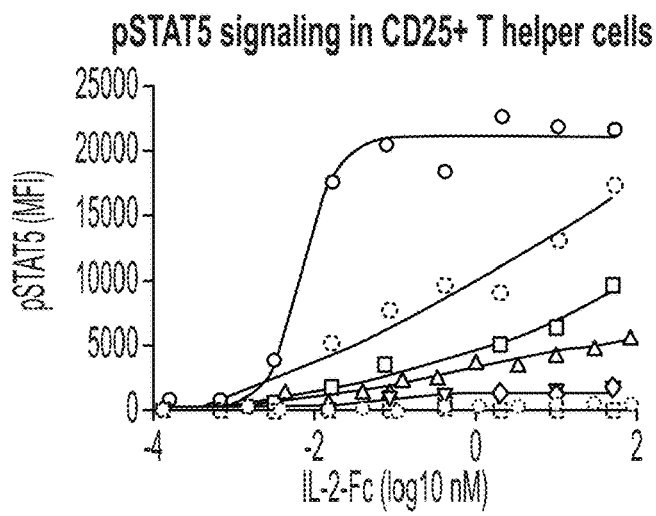
Figure 9C:
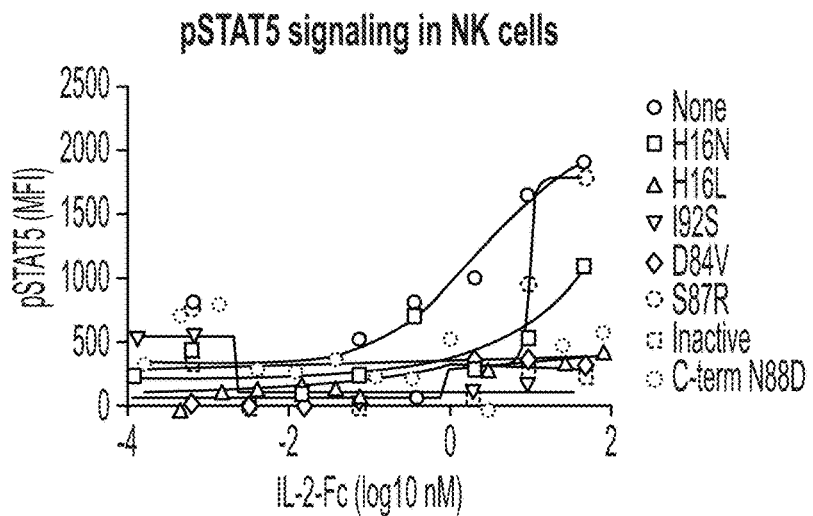
Figure 9D:
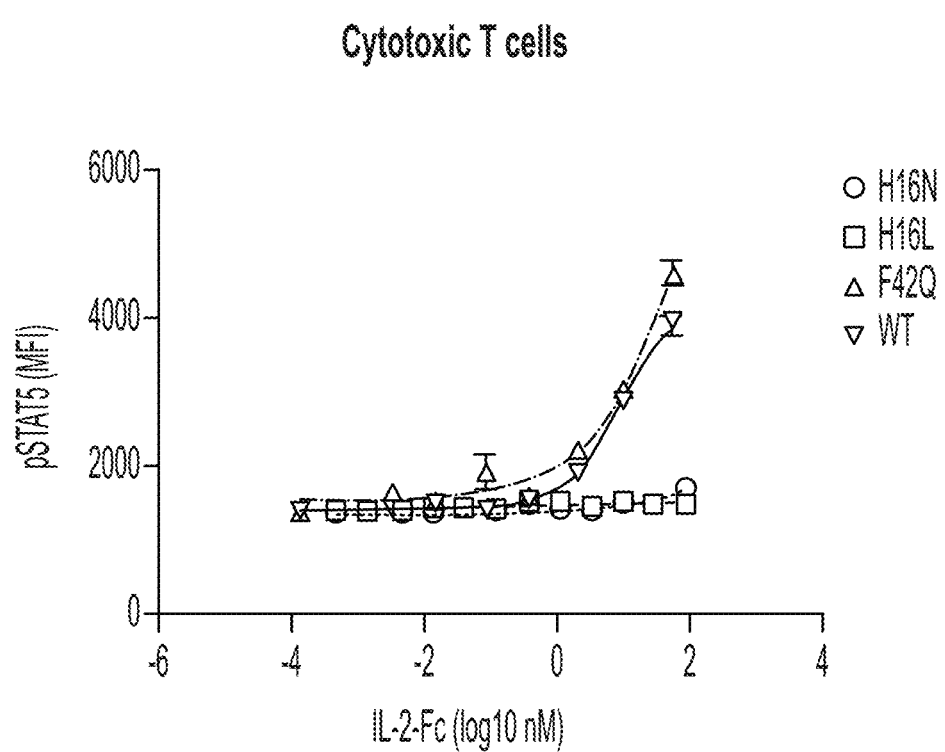
Figure 16A:
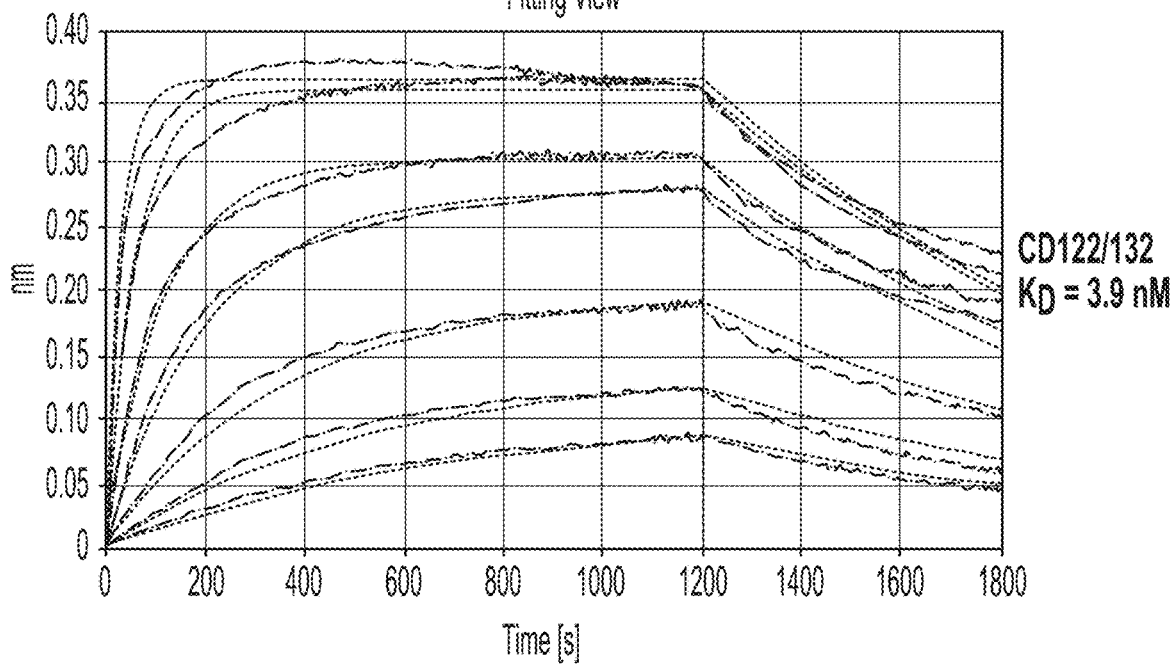
FIGS. 16A-16B provide graphs illustrating the binding kinetics of CD122/CD132 Fc heterodimer or CD25 extracellular domain at a range of concentrations to IL-2-Fc fusion proteins containing only V69A/Q74P mutations (wild-type.
Figure 16A:
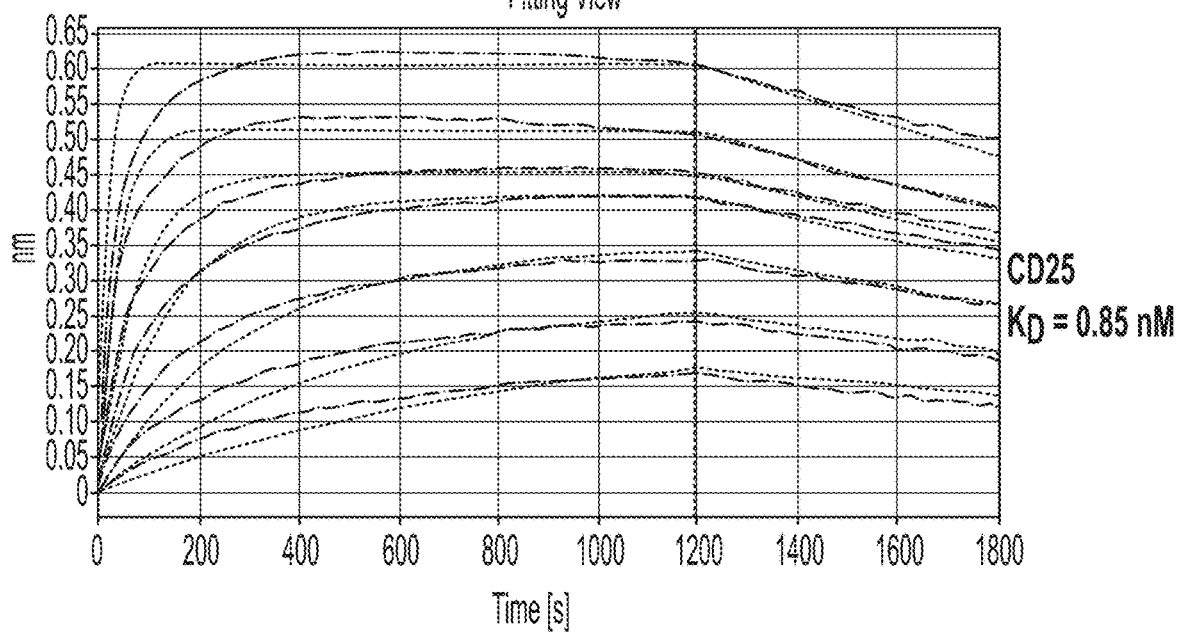
Figure 16B:
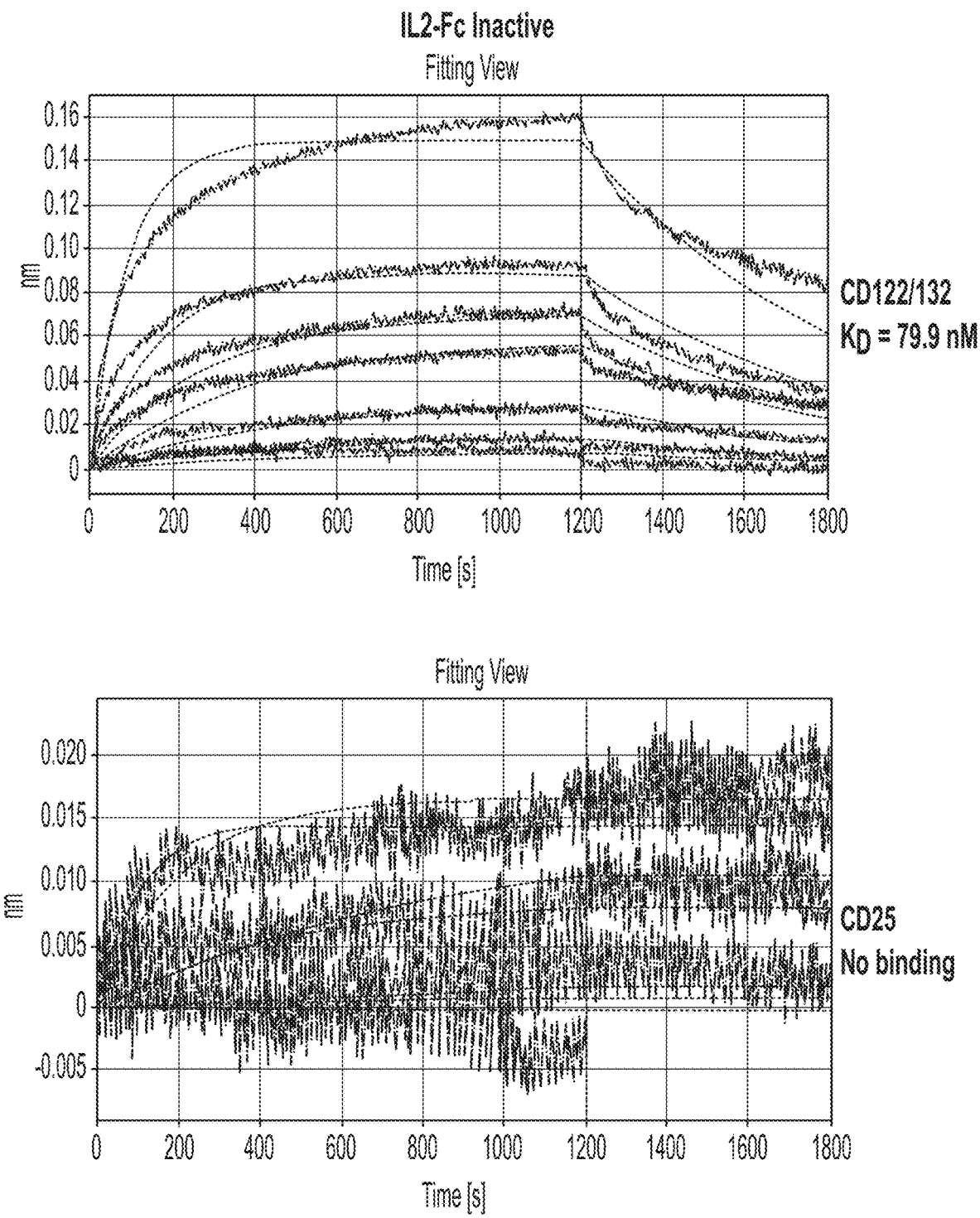

Example 8: Reducing the IL-2 Receptor Binding Affinity of IL-2-Fc Fusion Proteins Extends Their Lifetime In Vivo An important advantage of IL-2-Fc fusion proteins over existing therapy using IL-2 is expected to be extended lifetime in vivo (Bell et al. J Autoimmunity (2015) 56: 66-80). In the context of an Fc or antibody fusion protein, it is hypothesized that binding to the IL-2 receptors is a major route of clearance in vivo. We have tested this by treating Tg32 mice with an IL-2-Fc fusion protein that has reduced affinity for both CD25 and CD122 receptors (mutations F42A, Y45A, L72G, N88D, V69A, Q74P, C125S (SEQ ID NO: 30). FIG. 16 shows binding data that demonstrates the reduced affinity for both CD25 and CD122 compared to IL-2-Fc containing only V69A/Q74P/C125S mutations, and IL-2-Fc Inactive does not cause pSTAT5 phosphorylation in vitro in human PBMCs at any concentration tested (FIG. 9A).

Figure 17A:
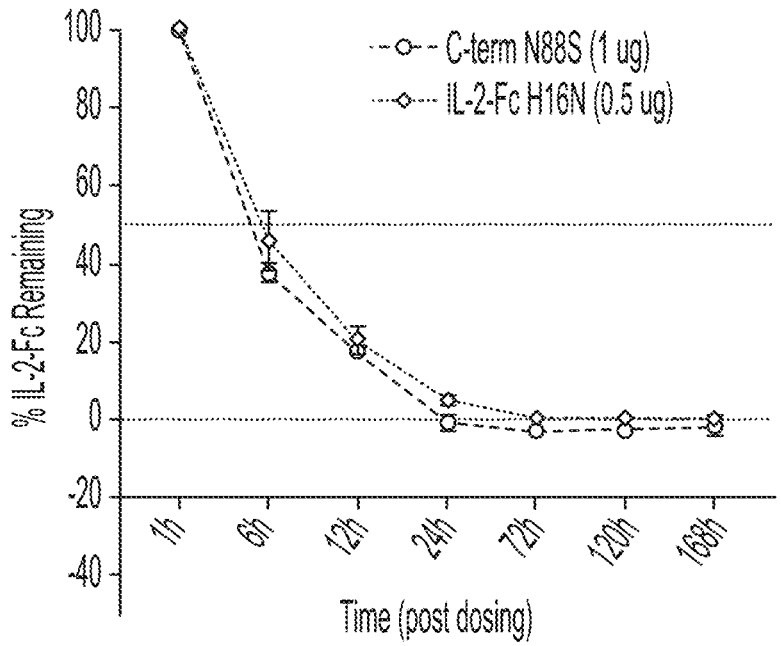
FIGS. 17A-17D provides graphs illustrating the clearance kinetics of IL-2 Fc fusion proteins in mice. Plasma was collected from mice treated as in FIG. 12 with various doses, as indicated, of IL-2-Fc fusion protein containing V69A/Q74P/H16N mutations or C-term N88D (FIGS. 17A-17B) or IL-2-Fc fusion protein containing inactivating mutations (42A, Y45A, L72G, N88D, V69A, Q74P; inactive.
Figure 17B:
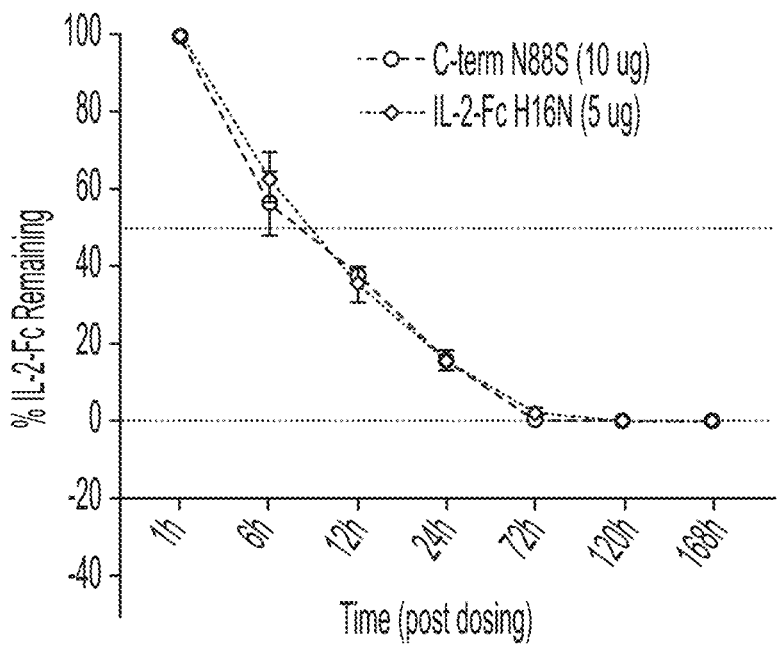
Figure 17C:
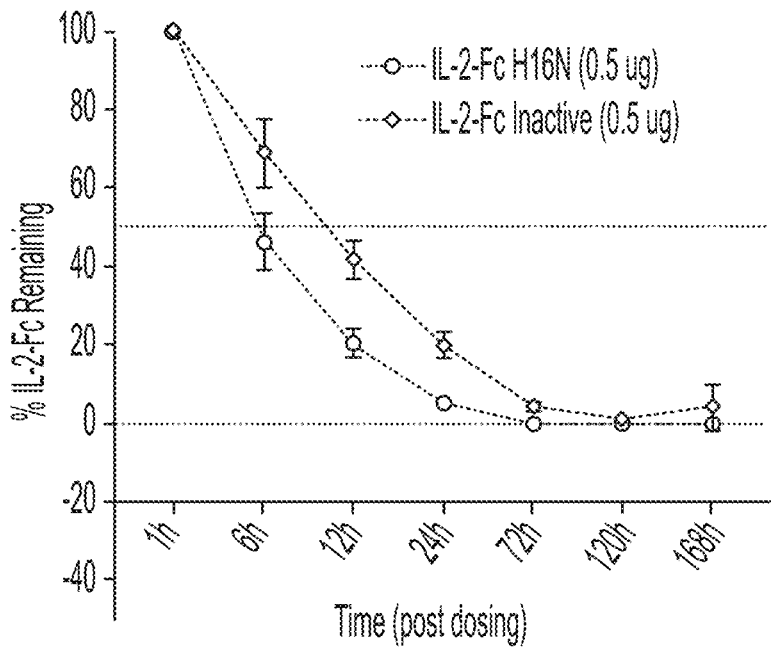
Figure 17D:
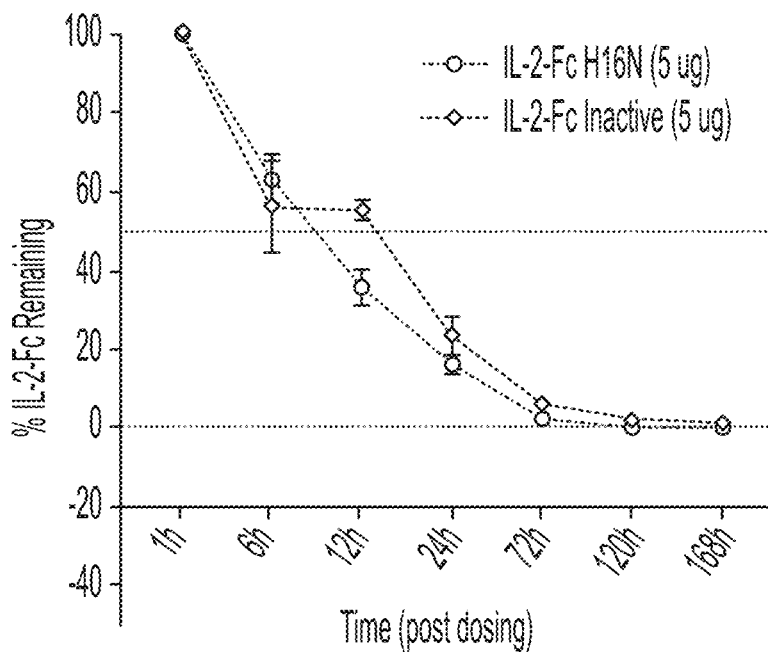

Plasma was collected from mice treated as in Example 7 with IL-2-Fc fusion proteins or C-term N88D. The amount of IL-2-Fc fusion protein or C-term N88D present at each time-point was measured using an ELISA assay with anti-IL-2 capture antibody (R&D Systems, AF-202) and anti-human Fc secondary antibody conjugated to horseradish peroxidase (Jackson ImmunoResearch 109-035-008). For analysis, 100% of starting material was defined as the amount detectable in blood plasma 1 hour after injection. Equimolar amounts of IL-2-Fc H16N and C-term N88D show essentially identical clearance kinetics at each dose level (FIG. 17A and FIG. 17B). In contrast, IL-2-Fc Inactive persists longer, especially at low doses (FIG. 17C and FIG. 17D).

This exemplary molecule demonstrates that lowering the affinity for IL-2 receptors could increase the lifetime of a therapeutic molecule in vivo. IL-2 mutations that reduce affinity for CD25 but retain activity on Tregs, such as those described in Example 4, could be used to extend the therapeutic lifetime of these IL-2-Fc fusion proteins, thereby extending the duration of clinical benefit and reducing the need for frequent dosing.

Figure 18A:
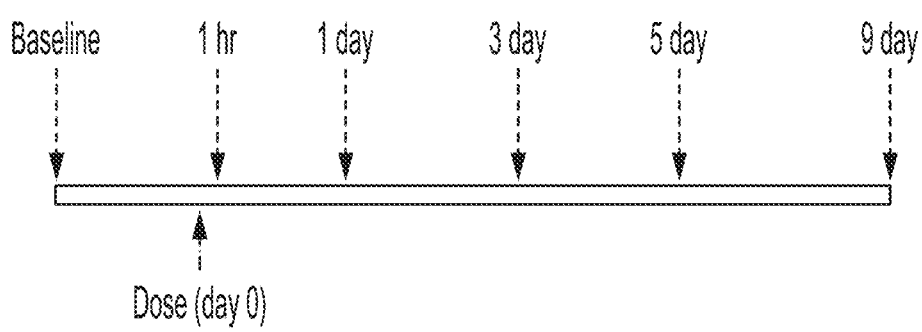
FIGS. 18A-18D depict expansion of immune cells in vivo following dosing with exemplary IL-2 Fc fusion proteins in humanized mice.
Figure 18B:
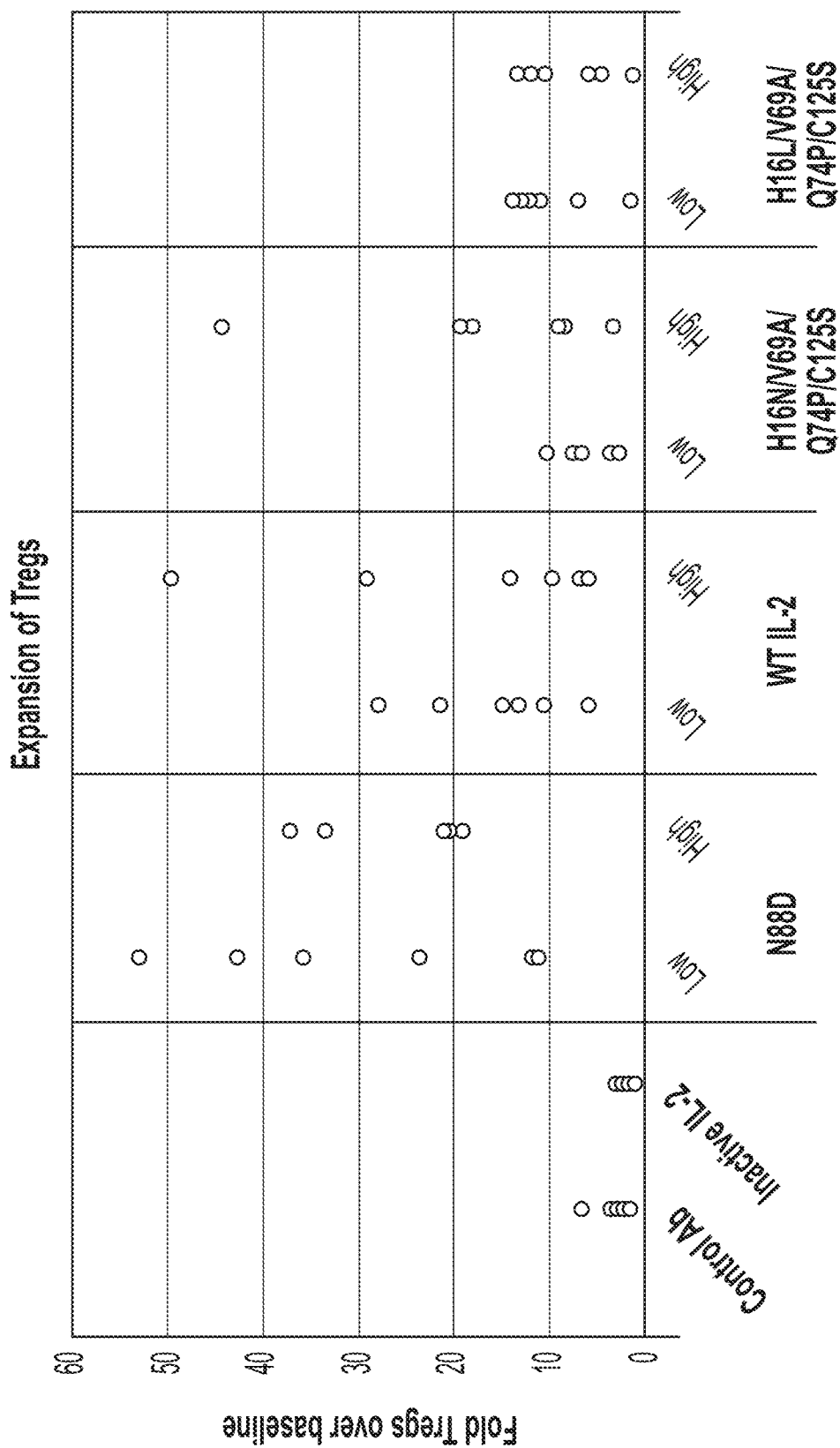
Figure 18C:
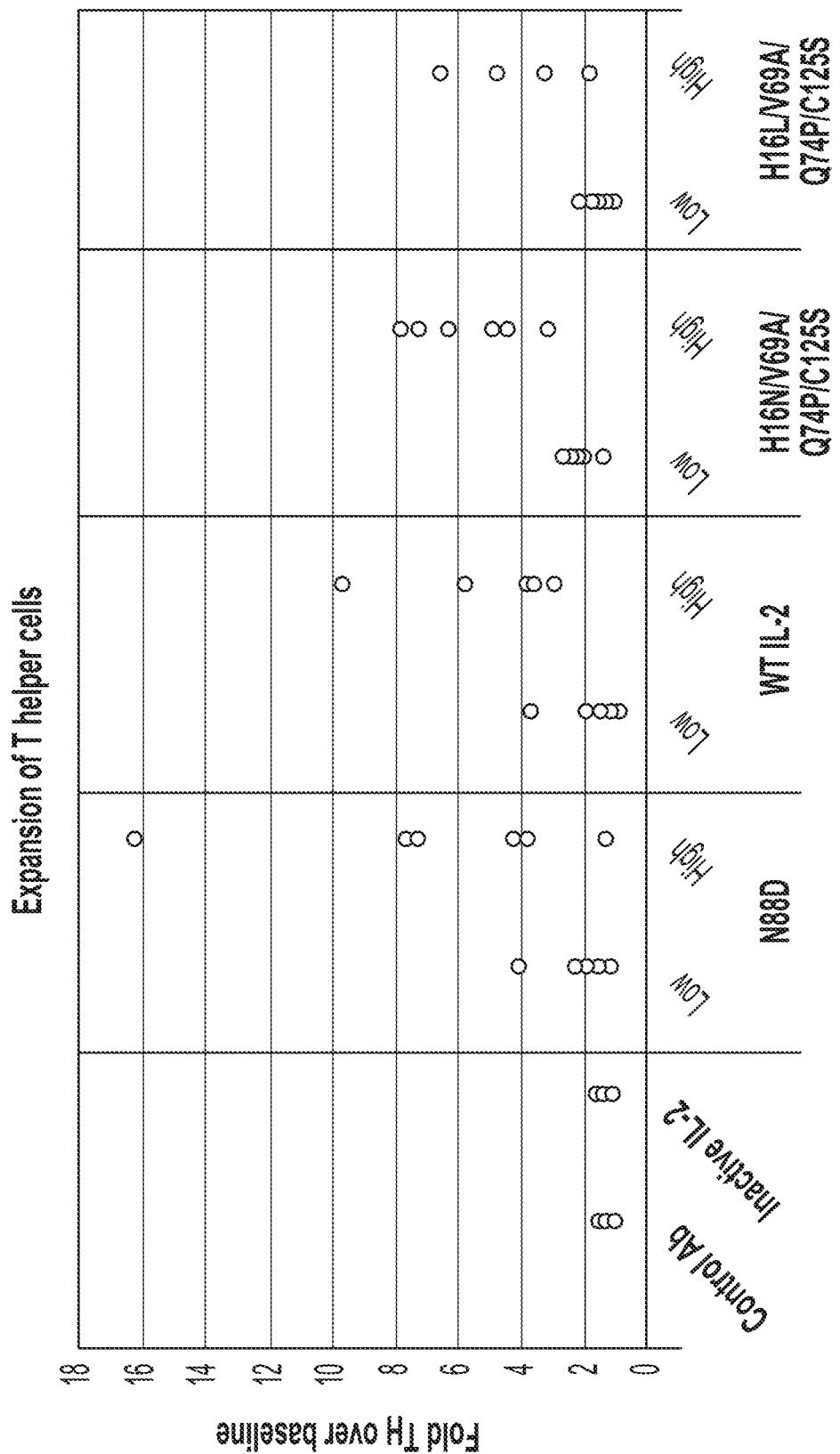
Figure 18D:
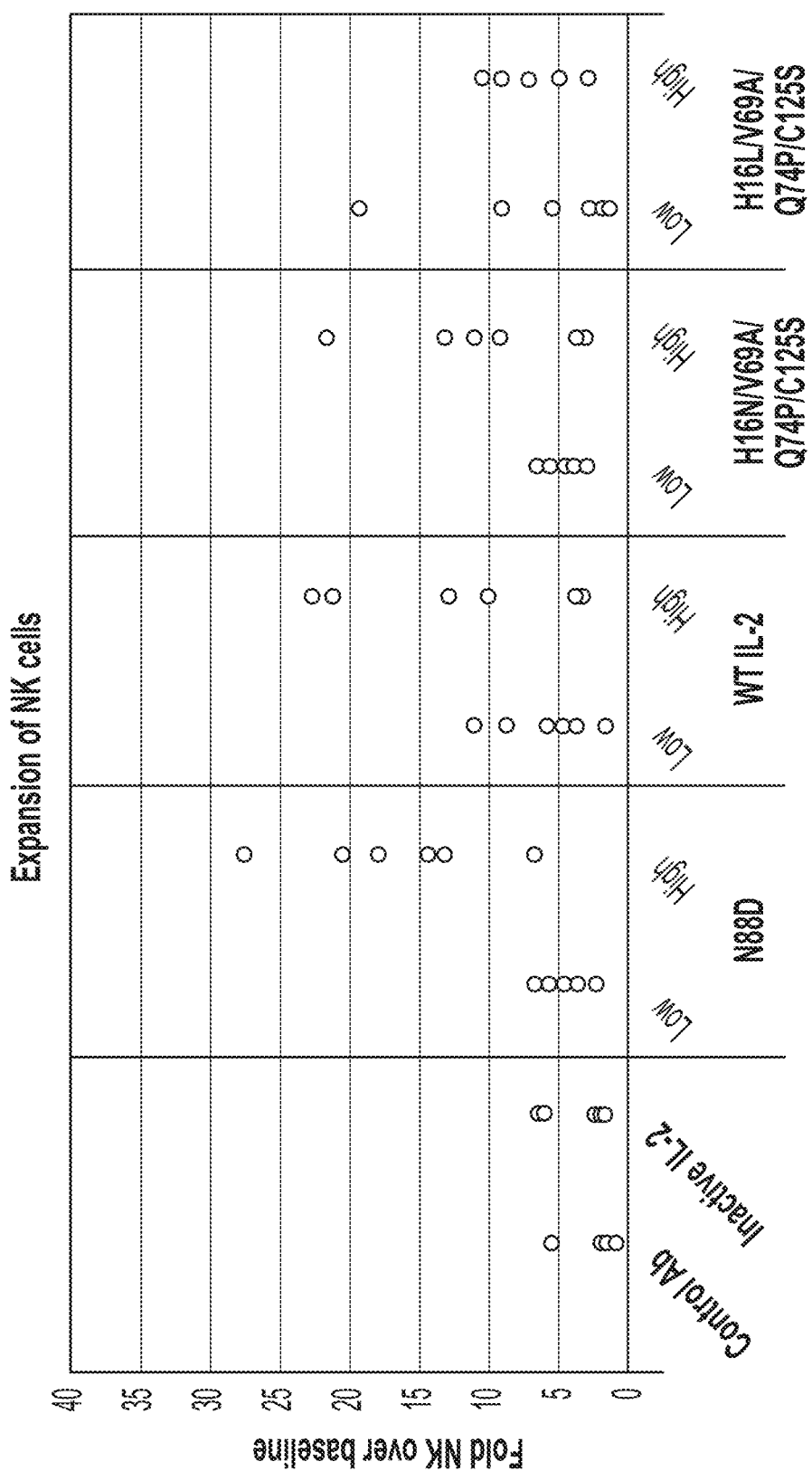

Example 9: IL-2-Fc Fusion Proteins Expand T Regulatory Cells, T Helper Cells, and NK Cells In Vivo in Humanized Mice NOD scid gamma (NSG) mice were lethally irradiated and reconstituted with human CD34+ umbilical cord stem cells in order to investigate the response of human immune cells to the IL-2-Fc fusion proteins. Seven experimental groups, with six mice in each group, were reconstituted using CD34+ umbilical cord stem cells isolated from three different human donors. Each donor reconstituted two mice per experimental group. After engraftment had fully occurred, the mice were injected subcutaneously with a low and/or a high dose of a control monoclonal antibody (Motavizumab), a control IL-2 Fc fusion protein with an inactive IL-2 moiety, a control IL-2 Fc fusion protein with a wild-type IL-2 protein, and three different IL-2-Fc fusion proteins comprising different mutations within the IL-2 moiety. Table 12 summarizes the doses and experimental treatment groups investigated. Following injection, blood was obtained from the mice at various timepoints, as indicated in FIG. 18A, and flow cytometry was performed to measure the various lymphocyte populations at these timepoints (FIG. 18A). Fold-expansion of T regulatory cells, T helper cells and NK cells at up to day 9 following dosing was quantified by flow cytometry similarly to Example 7, and is shown in FIG. 18B, FIG. 18C, and FIG. 18D, respectively.

TABLE 12

IL-2-Fc fusion proteins and control proteins and corresponding doses administered to the humanized mice reconstituted with human CD34+ umbilical cord stem cells

| Experimental Group (6 mice per group) | Treatment | Low Dose (µg/kg) | High Dose (µg/kg) |
|---|---|---|---|
| 1 | Motavizumab | 800 µg/kg (equimolar) | |
| 2 | Inactive IL-2 | 400 µg/kg | |
| 3 | N88D (C-term) | 100 µg/kg (equimolar) | 800 µg/kg (equimolar) |
| 4 | Wild-type IL-2 | 50 µg/kg | 400 µg/kg |
| 5 | H16N, V69A, Q74P, C125S (SEQ ID NO: 1007) | 50 µg/kg | 400 µg/kg |
| 6 | H16L, V69A, Q74P, C125S (SEQ ID NO: 1008) | 50 µg/kg | 400 µg/kg |

Example 10: IL-2-Fc Fusion Proteins Have Lifetime of Days in Circulation

Figure 19A:
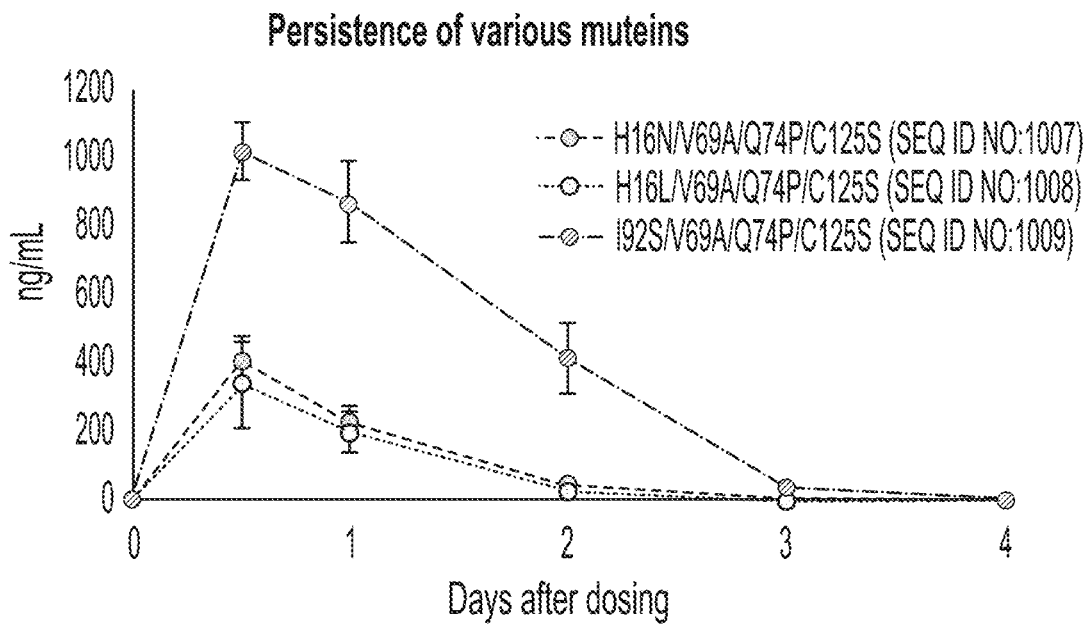
FIGS. 19A-19B depict the persistence and effective half-life of exemplary IL-2 fusion proteins in Tg32 mice.
Figure 19B:
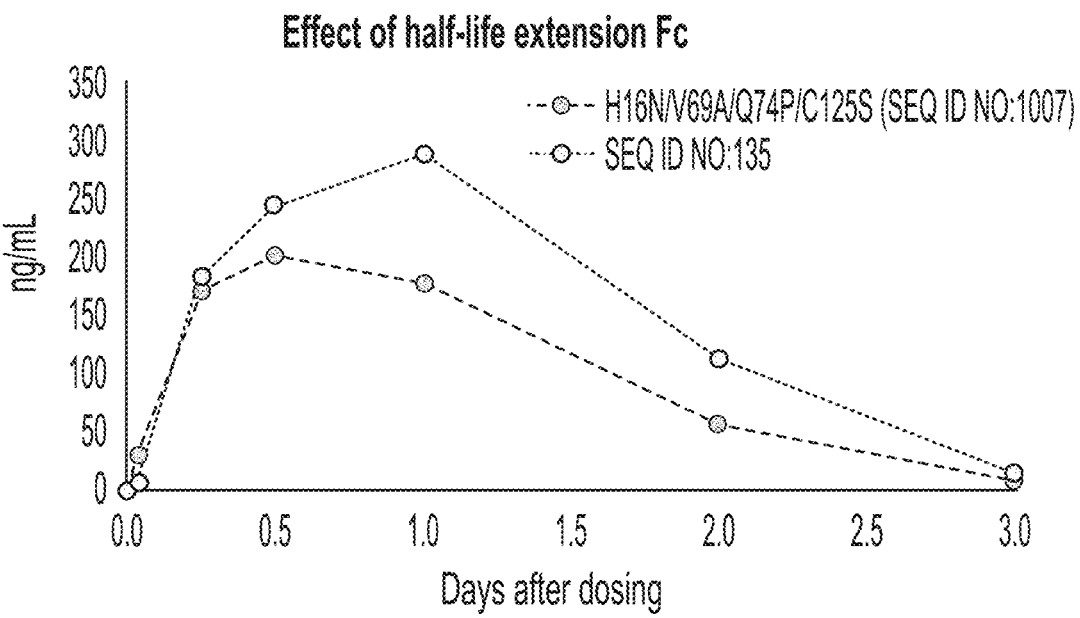

Tg32 mice (Jackson Labs, Bar Harbor Me., stock #014565) were injected subcutaneously with 5 µg of an IL-2 fusion protein comprising a combination of mutations (FIGS. 19A-19B). All IL-2 fusion proteins investigated contained the V69A/Q74P/C125S mutations in combination with either the H16N, H16L, or I92S mutation (FIG. 19A). These correspond to SEQ ID NOs: 1007, 1008, and 1009, respectively. Additionally, the half-life of two IL-2 fusion proteins comprising the H16N/V69A/Q74P/C125S mutations in the IL-2 moiety with or without an additional mutation in the Fc region were compared (FIG. 19B). These IL-2 fusion proteins correspond to SEQ ID NOs: 1007 and 135. Following injection with the exemplary IL-2 fusion proteins, blood was collected at the time points indicated in FIGS. 19A-19B. Plasma was isolated from the blood and the concentrations of the IL-2 fusion proteins were measured as described in Example 8.

As depicted in FIG. 19A, all IL-2 fusion proteins with the indicated mutations showed maximum distribution within the first 12 hours after injection. The I92S mutation led to the greatest amount of circulating IL-2 fusion protein in the plasma of the mice.

As shown in FIG. 19B, increasing the affinity of the Fc sequence for FcRn (SEQ ID NO: 135) modestly increased the lifetime of the IL-2 fusion protein, as compared to the IL-2 fusion protein comprising the same mutations in the IL-2 moiety but no additional mutation in the Fc sequence (SEQ ID NO: 1007).

Example 11: IL-2-Fc Fusion Protein Selectively Expands T Regulatory Cells In Vivo in Cynomolgus Monkeys The pharmacokinetic and pharmacodynamic profile of an exemplary IL-2-Fc fusion protein, i.e., the IL-2-Fc fusion protein comprising the mutations H16L/V69A/Q74P/C125S (SEQ ID NO:1008) (IL2-118 fused to IgG1 Fc N297G allotype m3), and its effect on the expansion and proliferation of immune cells were investigated in vivo in cynomolgus monkeys. Monkeys were subcutaneously administered 100 µg/kg of the IL-2-Fc fusion protein or a placebo (phosphate-buffered saline) once weekly (day 1, 8, 15, and 22) for four weeks. The four weekly dosing was followed by a four-week recovery period.

Figure 20:
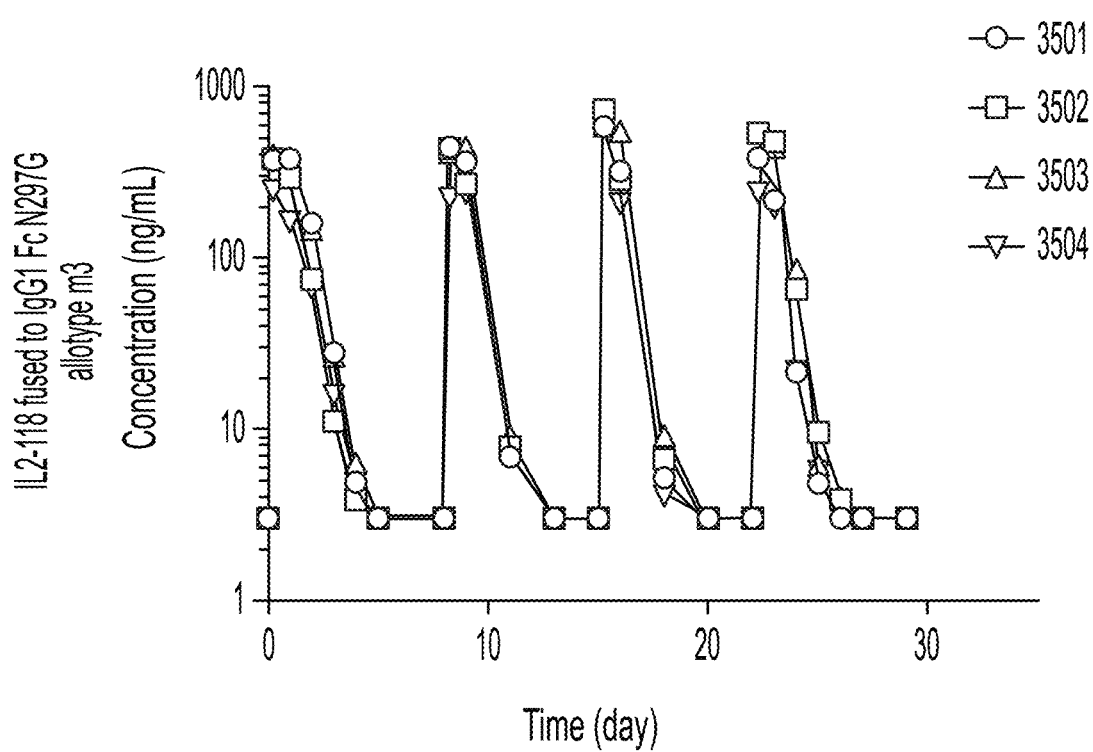
FIG. 20 depicts the pharmacokinetic profile of an exemplary IL-2-Fc fusion protein (comprising the mutations H16L/V69A/Q74P/C125S (SEQ ID NO:1008) (IL2-118 fused to IgG1 Fc N297G allotype m3)) in cynomolgus monkeys. Serum levels of the IL-2-Fc fusion protein were measured over time in four monkeys (numbered 3501, 3502, 3503, and 3504), following four weekly injections of 100 µg/kg of the IL-2-Fc fusion protein.

The exemplary IL-2-Fc fusion protein was well tolerated in all monkeys, with no clinical signs or observations observed during the 4-week dosing or the 4-week recovery periods. With respect to the pharmacokinetics of the IL-2-Fc fusion protein, the data demonstrate a rapid initial absorption phase (Tmax<24 hours for all animals), followed by an elimination phase (half-life ($t_{1/2}$) was approximately 10 hours) (FIG. 20). Serum levels of the IL-2-Fc fusion protein in the monkeys over time is summarized in FIG. 20.

Figure 21B:
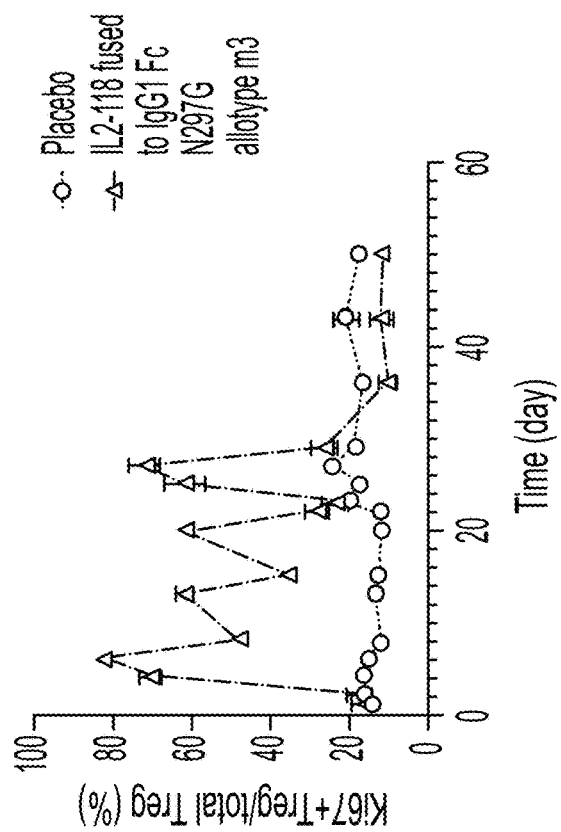
FIGS. 21A-21B depict the effects of an exemplary IL-2-Fc fusion protein (comprising the mutations H16L/V69A/Q74P/C125S (SEQ ID NO:1008) (IL2-118 fused to IgG1 Fc N297G allotype m3)) on expansion and proliferation of T regulatory cells in cynomolgus monkeys.
Figure 21A:
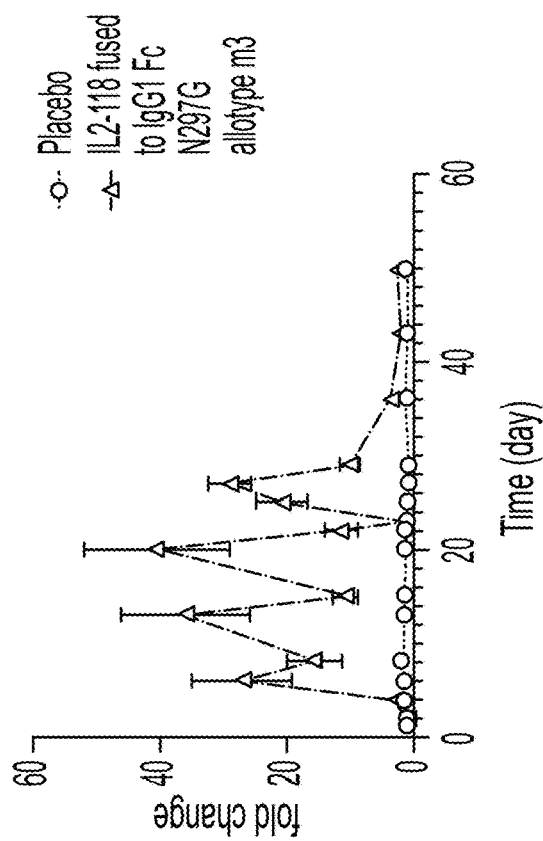

The effects of the exemplary IL-2-Fc fusion protein on immune cell expansion following administration in monkeys was also investigated. Flow cytometry was used for the quantification of circulating immune cell subsets following treatment with the IL-2-Fc fusion protein or the placebo control. Table 13 lists the intracellular and cell surface markers and corresponding cell populations that were analyzed. As shown in FIG. 21A, the IL-2-Fc fusion protein significantly increased the amount of T regulatory cells in monkeys as compared to the placebo control. Further, as shown in FIG. 21B, up to 80% of the regulatory T cells stained positive for Ki67 (a marker for cell proliferation) in monkeys that received the IL-2-Fc fusion protein. Taken together, these data indicate that regulatory T cells were hyperproliferative and showed increased expansion in response to the IL-2-Fc fusion protein.

Figures 22A, 22B:
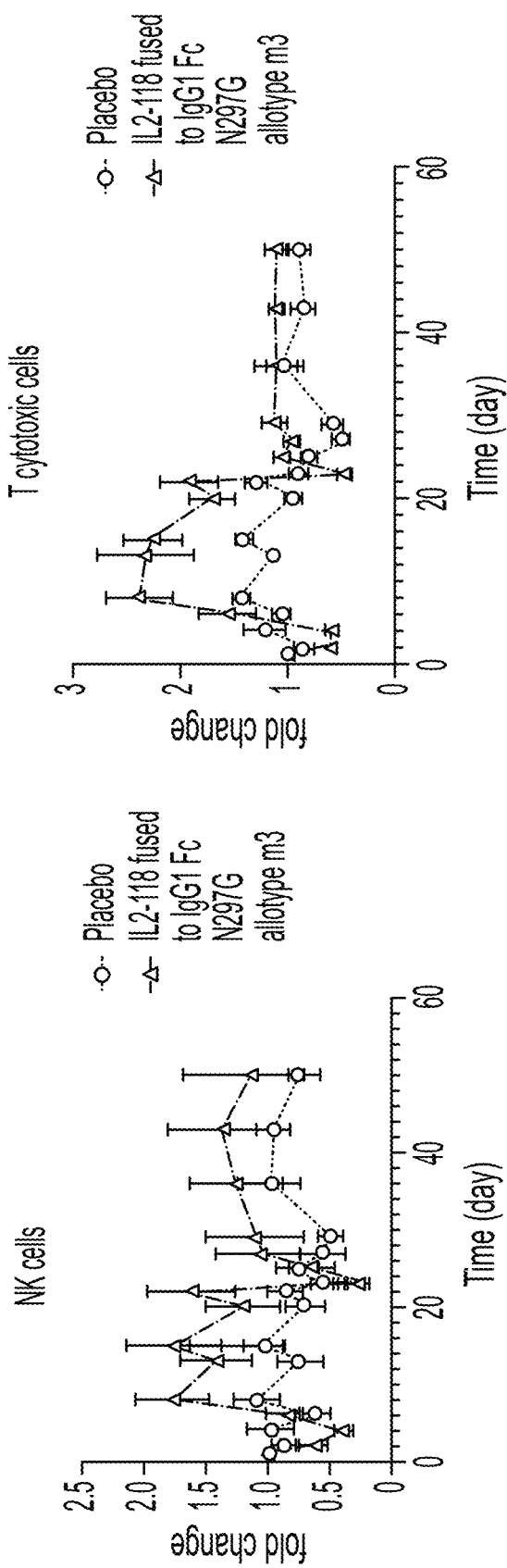
FIGS. 22A-22D depict the effects of an exemplary IL-2-Fc fusion protein (comprising the mutations H16L/V69A/Q74P/C125S (SEQ ID NO:1008) (IL2-118 fused to IgG1 Fc N297G allotype m3)) on circulating immune cells in cynomolgus monkeys following four weekly injections of 100 µg/kg of the IL-2-Fc fusion protein.
Figure 22D:
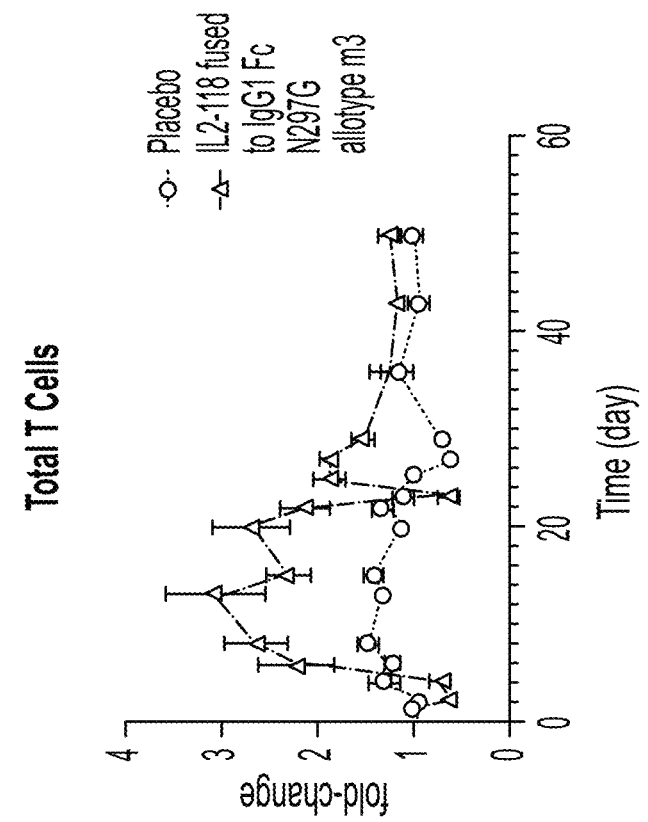
Figure 22C:
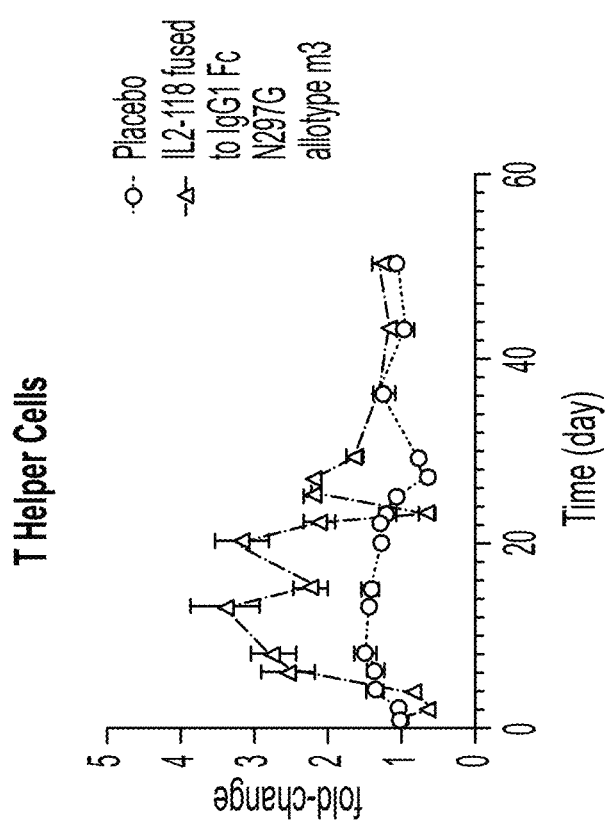

As shown in FIGS. 22A-22D, the IL-2-Fc fusion protein did not result in an increase in the expansion of NK cells (FIG. 22A), cytotoxic T cells (FIG. 22B), helper T cells (FIG. 22C), or total T cells (FIG. 22D).

In summary, these data indicate that IL2-118 fused to IgG1 Fc N297G allotype m3 was able to selectively expand regulatory T cells in vivo.

TABLE 13

List of intracellular and cell surface markers and corresponding cellular populations for flow cytometric analysis of circulating immune cells Immunophenotyping Antigens and Cell Populations

| Antigen Marker | Cell Population Identified |
|---|---|
| CD45+/CD3+/CD20−/CD159a− | Total T-lymphocytes |
| CD45+/CD3+/CD20−/CD159a−/CD4+/CD8− | T-helper lymphocytes |

TABLE 13-continued

List of intracellular and cell surface markers and corresponding cellular populations for flow cytometric analysis of circulating immune cells Immunophenotyping Antigens and Cell Populations

| Antigen Marker | Cell Population Identified |
|---|---|
| CD45+/CD3+/CD20−/CD159a−/CD4−/CD8+ | T-cytotoxic lymphocytes |
| CD45+/CD3−/CD20−/CD159a+ | CD159a+ Natural-killer cells |
| CD3+/CD159a−/CD4+/CD8−/CD25+/FoxP3+ | Regulatory T-helper-lymphocytes |
| CD3+/CD159a−/CD4+/CD8−/CD25+/FoxP3+/Ki67+ | Proliferating Regulatory T-helper-lymphocytes |

Example 12: IL-2-Fc Fusion Protein Reduces Kidney Damage in a Mouse Model of Lupus Nephritis The MRL/MpJ-Faslpr/J strain of mice (Jackson Labs, Bar Harbor Me., stock #000485) are homozygous for mutation in the Fas gene, leading to systemic autoimmunity that resembles human systemic lupus erythematosus (SLE) with kidney involvement similar to human lupus nephritis. These mice were used to investigate the ability of IL-2-Fc fusion proteins to induce T regulatory cell expansion by measuring impact on disease progression in this model of SLE.

Groups of up to 30 mice were treated subcutaneously with PBS vehicle control, or an exemplary IL-2-Fc fusion protein described herein at 40 µg/kg, every 3 days. Treatment began at 11 weeks of age and continued until the end of the study when mice were 18 weeks old. Disease scoring included proteinuria as measured weekly in all mice, analysis of glomerular lesions by kidney histology as measured at the end of the study, blood urea nitrogen (BUN) as measured at the end of the study, and quantitative measurement of antibodies in serum recognizing double stranded DNA (anti-dsDNA antibodies).

Figure 23A:
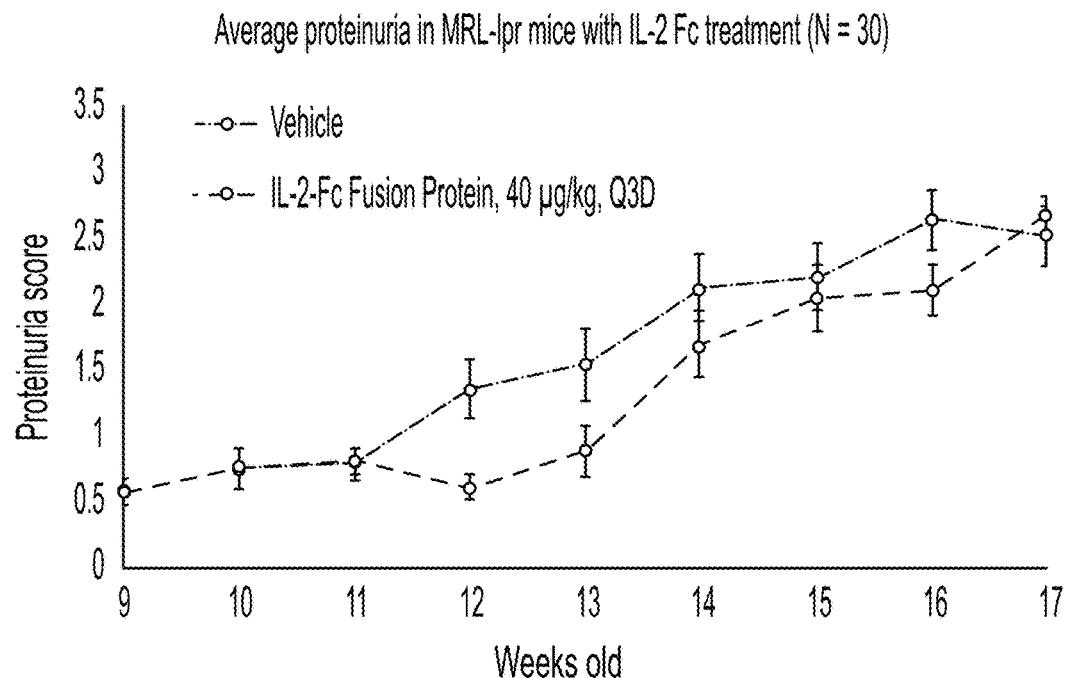
FIGS. 23A-23C depict the effects of an exemplary IL-2-Fc fusion protein described herein on disease progression in a murine model of systemic lupus erythematosus with kidney involvement similar to lupus nephritis.
Figure 23B:
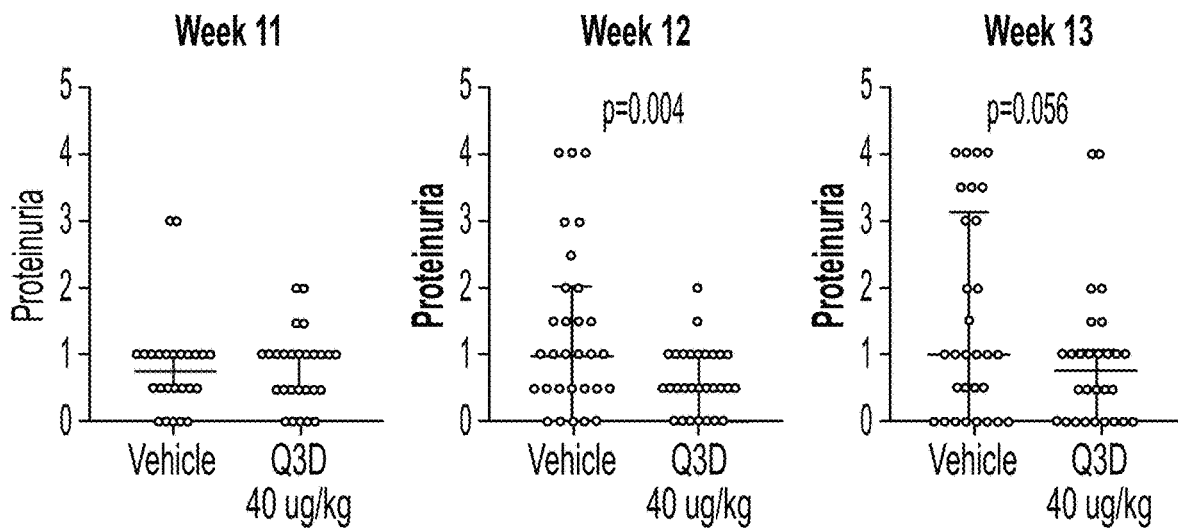

FIG. 23A shows average proteinuria in the two groups throughout the course of the study. Early in the study the treated group showed lower average proteinuria, with greatest statistical significance when the mice were 12 weeks old (p=0.004 using two-tailed unpaired t-test) and 13 weeks old (p=0.056) (FIG. 23B, center and right panel).

Figure 23C:
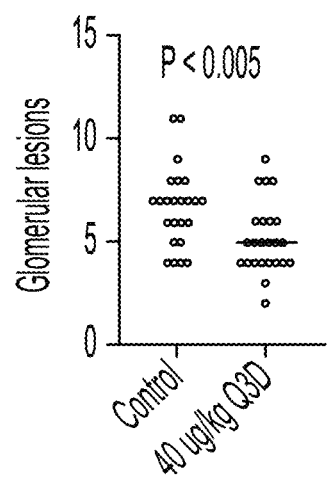

Kidney histology was also performed at the end of the study to evaluate glomerular lesions, which are indicative of kidney damage. An analysis protocol was used with analysts blinded to the treatment groups. The average number of lesions identified in untreated mice was 6.72 while the average in treated mice was 5.167 (FIG. 23C). This result was statistically significant with p<0.005 (two-tailed unpaired t-test), indicating that the treated group had accumulated less kidney damage over the course of the study. No difference was observed in anti-dsDNA antibodies or BUN.

In summary, these data indicate that the exemplary IL-2-Fc fusion protein impacts disease progression in a murine model of lupus nephritis.

Large Tables

The specification includes two large tables, Table 9 and Table 10, which have been submitted in read-only optical discs. Table 9 and Table 10 are available in electronic format from the USPTO. Table 9 and Table 10 are also available from the USPTO upon request and payment of the fees set forth in 37 CFR 1.19(b)(3).

INCORPORATION BY REFERENCE

All publications, patents, and Accession numbers mentioned herein are hereby incorporated by reference in their entirety as if each individual publication or patent was specifically and individually indicated to be incorporated by reference.

EQUIVALENTS

While specific embodiments of the subject invention have been discussed, the above specification is illustrative and not restrictive. Many variations of the invention will become apparent to those skilled in the art upon review of this specification and the claims below. The full scope of the invention should be determined by reference to the claims, along with their full scope of equivalents, and the specification, along with such variations.

Lengthy table referenced here

US12084484-20240910-T00001

Please refer to the end of the specification for access instructions.

Lengthy table referenced here

US12084484-20240910-T00002

Please refer to the end of the specification for access instructions.

LENGTHY TABLES

The patent contains a lengthy table section. A copy of the table is available in electronic form from the USPTO web site (https://seqdata.uspto.gov/?pageRequest=docDetail&DocID=US12084484B2). An electronic copy of the table will also be available from the USPTO upon request and payment of the fee set forth in 37 CFR 1.19(b)(3).

SEQUENCE LISTING (1032 sequences)

SEQ ID NO: 1 - protein, 133 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLT

SEQ ID NO: 2 - protein, 133 aa, Artificial Sequence [sequence omitted]

SEQ ID NO: 3 - protein, 133 aa, Artificial Sequence
  Description of Artificial Sequence: Synthetic polypeptide
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 4 - protein, 133 aa, Artificial Sequence
  Description of Artificial Sequence: Synthetic polypeptide
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 5 - protein, 133 aa, Artificial Sequence
  Description of Artificial Sequence: Synthetic polypeptide
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 6 - protein, 133 aa, Artificial Sequence
  Description of Artificial Sequence: Synthetic polypeptide
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 7 - protein, 133 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLT

SEQ ID NO: 8 - protein, 133 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLT

SEQ ID NO: 9 - protein, 133 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLT

SEQ ID NO: 10 - protein, 133 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLT

SEQ ID NO: 11 - protein, 133 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 12 - protein, 133 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 13 - protein, 133 aa, Artificial Sequence
  Description of Artificial Sequence: Synthetic polypeptide
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 14 - protein, 133 aa, Artificial Sequence
  Description of Artificial Sequence: Synthetic polypeptide
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 15 - protein, 133 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLT

SEQ ID NO: 16 - protein, 133 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 17 - protein, 133 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 18 - protein, 133 aa, Artificial Sequence
  Description of Artificial Sequence: Synthetic polypeptide
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 19 - protein, 133 aa, Artificial Sequence
  Description of Artificial Sequence: Synthetic polypeptide
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 20 - protein, 133 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLT

SEQ ID NO: 21 - protein, 133 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 22 - protein, 133 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 23 - protein, 133 aa, Artificial Sequence
  Description of Artificial Sequence: Synthetic polypeptide
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 24 - protein, 133 aa, Artificial Sequence
  Description of Artificial Sequence: Synthetic polypeptide
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 25 - protein, 133 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLT

SEQ ID NO: 26 - protein, 133 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 27 - protein, 133 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 28 - protein, 133 aa, Artificial Sequence
  Description of Artificial Sequence: Synthetic polypeptide
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLT

SEQ ID NO: 29 - protein, 133 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLT

SEQ ID NO: 30 - protein, 133 aa, Artificial Sequence
  Description of Artificial Sequence: Synthetic polypeptide
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLT

SEQ ID NO: 31 - protein, 133 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLT

SEQ ID NO: 32 - protein, 133 aa, Artificial Sequence
  Description of Artificial Sequence: Synthetic polypeptide
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 33 - protein, 133 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLT

SEQ ID NO: 34 - protein, 133 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLT

SEQ ID NO: 35 - protein, 133 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 36 - protein, 133 aa, Artificial Sequence
  Description of Artificial Sequence: Synthetic polypeptide
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLT

SEQ ID NO: 37 - protein, 133 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLT

SEQ ID NO: 38 - protein, 133 aa, Artificial Sequence
  Description of Artificial Sequence: Synthetic polypeptide
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 39 - protein, 227 aa, Homo sapiens
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 41 - protein, 227 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 43 - protein, 227 aa, Artificial Sequence
  Description of Artificial Sequence: Synthetic polypeptide
DKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 44 - protein, 229 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 45 - protein, 229 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 46 - protein, 229 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 47 - protein, 229 aa, Artificial Sequence
  Description of Artificial Sequence: Synthetic polypeptide
ESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 48 - protein, 20 aa, Artificial Sequence
  Description of Artificial Sequence: Synthetic peptide
GGGGSGGGGSGGGGSGGGGS

SEQ ID NO: 49 - protein, 36 aa, Artificial Sequence
  Description of Artificial Sequence: Synthetic polypeptide
AGSGGSGGSGGSPVPSTPPTNSSSTPPTPSPSASGS

SEQ ID NO: 50 - protein, 44 aa, Artificial Sequence
  Description of Artificial Sequence: Synthetic polypeptide
AGSGGSGGSGGSPVPSTPPTPSPSTPPTPSPSGGSGNSSGSGGS

SEQ ID NO: 51 - protein, 48 aa, Artificial Sequence
  Description of Artificial Sequence: Synthetic polypeptide
AGSGNSSGSGGSGGSGNSSGSGGSPVPSTPPTPSPSTPPTPSPSASGS

SEQ ID NO: 52 - protein, 24 aa, Artificial Sequence
  Description of Artificial Sequence: Synthetic peptide
AEAAAKEAAAKEAAAKEAAAKAGS

SEQ ID NO: 53 - protein, 25 aa, Artificial Sequence
  Description of Artificial Sequence: Synthetic peptide
GTTPNPPASSSTTGSSTPTNPPAGS

SEQ ID NO: 54 - protein, 37 aa, Artificial Sequence
  Description of Artificial Sequence: Synthetic polypeptide
AGSPGAGNGGNNGGNPPPPTTTTSSAPATTTTASAGS

SEQ ID NO: 55 - protein, 22 aa, Artificial Sequence
  Description of Artificial Sequence: Synthetic peptide
GGGSAGGGSAGGGSAGGGSAGS

SEQ ID NO: 56 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 57 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 58 - protein, 380 aa, Artificial Sequence
  Description of Artificial Sequence: Synthetic polypeptide
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 59 - protein, 380 aa, Artificial Sequence
  Description of Artificial Sequence: Synthetic polypeptide
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 60 - protein, 380 aa, Artificial Sequence
  Description of Artificial Sequence: Synthetic polypeptide
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 61 - protein, 380 aa, Artificial Sequence
  Description of Artificial Sequence: Synthetic polypeptide
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 62 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 64 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 65 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 66 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 68 - protein, 380 aa, Artificial Sequence
  Description of Artificial Sequence: Synthetic polypeptide
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 380 aa, Artificial Sequence
  Description of Artificial Sequence: Synthetic polypeptide
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 70 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 71 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 72 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 73 - protein, 380 aa, Artificial Sequence
  Description of Artificial Sequence: Synthetic polypeptide
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 380 aa, Artificial Sequence
  Description of Artificial Sequence: Synthetic polypeptide
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 75 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 76 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 77 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 78 - protein, 380 aa, Artificial Sequence
  Description of Artificial Sequence: Synthetic polypeptide
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 79 - protein, 380 aa, Artificial Sequence
  Description of Artificial Sequence: Synthetic polypeptide
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 80 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 81 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 82 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - protein, 380 aa, Artificial Sequence
  Description of Artificial Sequence: Synthetic polypeptide
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 380 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - protein, 380 aa, Artificial Sequence
  Description of Artificial Sequence: Synthetic polypeptide
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - protein, 380 aa, Artificial Sequence
  Description of Artificial Sequence: Synthetic polypeptide
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 90 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - protein, 380 aa, Artificial Sequence
  Description of Artificial Sequence: Synthetic polypeptide
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 92 - protein, 380 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - protein, 380 aa, Artificial Sequence
  Description of Artificial Sequence: Synthetic polypeptide
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 94 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 96 - protein, 380 aa, Artificial Sequence
  Description of Artificial Sequence: Synthetic polypeptide
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - protein, 380 aa, Artificial Sequence
  Description of Artificial Sequence: Synthetic polypeptide
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 98 - protein, 380 aa, Artificial Sequence
  Description of Artificial Sequence: Synthetic polypeptide
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - protein, 380 aa, Artificial Sequence
  Description of Artificial Sequence: Synthetic polypeptide
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 100 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 102 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 103 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 105 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 106 - protein, 380 aa, Artificial Sequence
  Description of Artificial Sequence: Synthetic polypeptide
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 107 - protein, 380 aa, Artificial Sequence
  Description of Artificial Sequence: Synthetic polypeptide
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 108 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 109 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 110 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 111 - protein, 380 aa, Artificial Sequence
  Description of Artificial Sequence: Synthetic polypeptide
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 112 - protein, 380 aa, Artificial Sequence
  Description of Artificial Sequence: Synthetic polypeptide
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 113 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 114 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 115 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 116 - protein, 380 aa, Artificial Sequence
  Description of Artificial Sequence: Synthetic polypeptide
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 117 - protein, 380 aa, Artificial Sequence
  Description of Artificial Sequence: Synthetic polypeptide
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 118 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 120 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 121 - protein, 380 aa, Artificial Sequence
  Description of Artificial Sequence: Synthetic polypeptide
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 122 - protein, 380 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 123 - protein, 380 aa, Artificial Sequence
  Description of Artificial Sequence: Synthetic polypeptide
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 124 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 125 - protein, 380 aa, Artificial Sequence
  Description of Artificial Sequence: Synthetic polypeptide
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 126 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 129 - protein, 380 aa, Artificial Sequence
  Description of Artificial Sequence: Synthetic polypeptide
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - protein, 380 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - protein, 380 aa, Artificial Sequence
  Description of Artificial Sequence: Synthetic polypeptide
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 133 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 134 - protein, 380 aa, Artificial Sequence
  Description of Artificial Sequence: Synthetic polypeptide
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 135 - protein, 380 aa, Artificial Sequence
  Description of Artificial Sequence: Synthetic polypeptide
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 136 - protein, 380 aa, Artificial Sequence
  Description of Artificial Sequence: Synthetic polypeptide
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 137 - protein, 380 aa, Artificial Sequence
  Description of Artificial Sequence: Synthetic polypeptide
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 138 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 139 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 140 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 141 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 142 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 143 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 144 - protein, 380 aa, Artificial Sequence
  Description of Artificial Sequence: Synthetic polypeptide
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 145 - protein, 380 aa, Artificial Sequence
  Description of Artificial Sequence: Synthetic polypeptide
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 146 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 147 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 148 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 149 - protein, 380 aa, Artificial Sequence
  Description of Artificial Sequence: Synthetic polypeptide
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 150 - protein, 380 aa, Artificial Sequence
  Description of Artificial Sequence: Synthetic polypeptide
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 151 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 152 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 153 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 154 - protein, 380 aa, Artificial Sequence
  Description of Artificial Sequence: Synthetic polypeptide
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 155 - protein, 380 aa, Artificial Sequence
  Description of Artificial Sequence: Synthetic polypeptide
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 156 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 157 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 158 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 159 - protein, 380 aa, Artificial Sequence
  Description of Artificial Sequence: Synthetic polypeptide
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 160 - protein, 380 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 161 - protein, 380 aa, Artificial Sequence
  Description of Artificial Sequence: Synthetic polypeptide
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 162 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 163 - protein, 380 aa, Artificial Sequence
  Description of Artificial Sequence: Synthetic polypeptide
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 164 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 165 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 166 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 167 - protein, 380 aa, Artificial Sequence
  Description of Artificial Sequence: Synthetic polypeptide
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 168 - protein, 380 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 169 - protein, 380 aa, Artificial Sequence
  Description of Artificial Sequence: Synthetic polypeptide
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLQVLHVDWLNGKEYKCKVSNKALPAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 170 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 171 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 172 - protein, 380 aa, Artificial Sequence
  Description of Artificial Sequence: Synthetic polypeptide
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 173 - protein, 380 aa, Artificial Sequence
  Description of Artificial Sequence: Synthetic polypeptide
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 174 - protein, 380 aa, Artificial Sequence
  Description of Artificial Sequence: Synthetic polypeptide
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 175 - protein, 380 aa, Artificial Sequence
  Description of Artificial Sequence: Synthetic polypeptide
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 176 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 177 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 178 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 179 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 180 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 181 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 182 - protein, 380 aa, Artificial Sequence
  Description of Artificial Sequence: Synthetic polypeptide
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 183 - protein, 380 aa, Artificial Sequence
  Description of Artificial Sequence: Synthetic polypeptide
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 184 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 185 - protein, 380 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 186 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 187 - protein, 380 aa, Artificial Sequence
  Description of Artificial Sequence: Synthetic polypeptide
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 188 - protein, 380 aa, Artificial Sequence
  Description of Artificial Sequence: Synthetic polypeptide
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 189 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 190 - protein, 380 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 191 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 192 - protein, 380 aa, Artificial Sequence
  Description of Artificial Sequence: Synthetic polypeptide
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 193 - protein, 380 aa, Artificial Sequence
  Description of Artificial Sequence: Synthetic polypeptide
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 194 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 195 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 196 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 197 - protein, 380 aa, Artificial Sequence
  Description of Artificial Sequence: Synthetic polypeptide
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 198 - protein, 380 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 199 - protein, 380 aa, Artificial Sequence
  Description of Artificial Sequence: Synthetic polypeptide
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 200 - protein, 380 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 201 - protein, 380 aa, Artificial Sequence
  Description of Artificial Sequence: Synthetic polypeptide
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 202 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 203 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 204 - protein, 380 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 205 - protein, 380 aa, Artificial Sequence
  Description of Artificial Sequence: Synthetic polypeptide
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 206 - protein, 380 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 207 - protein, 380 aa, Artificial Sequence
  Description of Artificial Sequence: Synthetic polypeptide
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPEAAGGPSVFLFPPKPKDTLMISRTPEVTCVVVDVSHEDPEVKFNWYVDGVEVHNAKTKPREEQYNSTYRVVSVLQVLHVDWLNGKEYKCKVSNKALGAPIEKTISKAKGQPREPQVYTLPPSRDELTKNQVSLTCLVKGFYPSDIVVEWESNGQPENNYKTTPPVLDSDGSFFLYSKLTVDKSRWQQGNVFSCSVMHEALHNHYTQKSLSLSPGK

SEQ ID NO: 208 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 209 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 210 - protein, 382 aa, Artificial Sequence
  Description of Artificial Sequence: Synthetic polypeptide
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 211 - protein, 382 aa, Artificial Sequence
  Description of Artificial Sequence: Synthetic polypeptide
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 212 - protein, 382 aa, Artificial Sequence
  Description of Artificial Sequence: Synthetic polypeptide
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 213 - protein, 382 aa, Artificial Sequence
  Description of Artificial Sequence: Synthetic polypeptide
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 214 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 215 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 216 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 217 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 218 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 219 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 220 - protein, 382 aa, Artificial Sequence
  Description of Artificial Sequence: Synthetic polypeptide
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 221 - protein, 382 aa, Artificial Sequence
  Description of Artificial Sequence: Synthetic polypeptide
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 222 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 223 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 224 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 225 - protein, 382 aa, Artificial Sequence
  Description of Artificial Sequence: Synthetic polypeptide
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 226 - protein, 382 aa, Artificial Sequence
  Description of Artificial Sequence: Synthetic polypeptide
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 227 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 228 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 229 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 230 - protein, 382 aa, Artificial Sequence
  Description of Artificial Sequence: Synthetic polypeptide
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 231 - protein, 382 aa, Artificial Sequence
  Description of Artificial Sequence: Synthetic polypeptide
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 232 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 233 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 234 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 235 - protein, 382 aa, Artificial Sequence
  Description of Artificial Sequence: Synthetic polypeptide
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 236 - protein, 382 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 237 - protein, 382 aa, Artificial Sequence
  Description of Artificial Sequence: Synthetic polypeptide
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 238 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 239 - protein, 382 aa, Artificial Sequence
  Description of Artificial Sequence: Synthetic polypeptide
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 240 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 241 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 242 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 243 - protein, 382 aa, Artificial Sequence
  Description of Artificial Sequence: Synthetic polypeptide
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 244 - protein, 382 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 245 - protein, 382 aa, Artificial Sequence
  Description of Artificial Sequence: Synthetic polypeptide
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 246 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 247 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 248 - protein, 382 aa, Artificial Sequence
  Description of Artificial Sequence: Synthetic polypeptide
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 249 - protein, 382 aa, Artificial Sequence
  Description of Artificial Sequence: Synthetic polypeptide
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 250 - protein, 382 aa, Artificial Sequence
  Description of Artificial Sequence: Synthetic polypeptide
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 251 - protein, 382 aa, Artificial Sequence
  Description of Artificial Sequence: Synthetic polypeptide
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 252 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 253 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 254 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 255 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 256 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 257 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 258 - protein, 382 aa, Artificial Sequence
  Description of Artificial Sequence: Synthetic polypeptide
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 259 - protein, 382 aa, Artificial Sequence
  Description of Artificial Sequence: Synthetic polypeptide
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 260 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 261 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 262 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 263 - protein, 382 aa, Artificial Sequence
  Description of Artificial Sequence: Synthetic polypeptide
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 264 - protein, 382 aa, Artificial Sequence
  Description of Artificial Sequence: Synthetic polypeptide
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 265 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 266 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 267 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 268 - protein, 382 aa, Artificial Sequence
  Description of Artificial Sequence: Synthetic polypeptide
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 269 - protein, 382 aa, Artificial Sequence
  Description of Artificial Sequence: Synthetic polypeptide
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 270 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 271 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 272 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 273 - protein, 382 aa, Artificial Sequence
  Description of Artificial Sequence: Synthetic polypeptide
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 274 - protein, 382 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 275 - protein, 382 aa, Artificial Sequence
  Description of Artificial Sequence: Synthetic polypeptide
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 276 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 277 - protein, 382 aa, Artificial Sequence
  Description of Artificial Sequence: Synthetic polypeptide
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 278 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 279 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 280 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 281 - protein, 382 aa, Artificial Sequence
  Description of Artificial Sequence: Synthetic polypeptide
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 282 - protein, 382 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 283 - protein, 382 aa, Artificial Sequence
  Description of Artificial Sequence: Synthetic polypeptide
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQKSLSLSLGK

SEQ ID NO: 284 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 285 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 286 - protein, 382 aa, Artificial Sequence
  Description of Artificial Sequence: Synthetic polypeptide
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 287 - protein, 382 aa, Artificial Sequence
  Description of Artificial Sequence: Synthetic polypeptide
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 288 - protein, 382 aa, Artificial Sequence
  Description of Artificial Sequence: Synthetic polypeptide
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 289 - protein, 382 aa, Artificial Sequence
  Description of Artificial Sequence: Synthetic polypeptide
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 290 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 291 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 292 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 293 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 294 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 295 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 296 - protein, 382 aa, Artificial Sequence
  Description of Artificial Sequence: Synthetic polypeptide
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 297 - protein, 382 aa, Artificial Sequence
  Description of Artificial Sequence: Synthetic polypeptide
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 298 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 299 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 300 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 301 - protein, 382 aa, Artificial Sequence
  Description of Artificial Sequence: Synthetic polypeptide
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 302 - protein, 382 aa, Artificial Sequence
  Description of Artificial Sequence: Synthetic polypeptide
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 303 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 304 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 305 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 306 - protein, 382 aa, Artificial Sequence
  Description of Artificial Sequence: Synthetic polypeptide
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 307 - protein, 382 aa, Artificial Sequence
  Description of Artificial Sequence: Synthetic polypeptide
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 308 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 309 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 310 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 311 - protein, 382 aa, Artificial Sequence
  Description of Artificial Sequence: Synthetic polypeptide
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 312 - protein, 382 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 313 - protein, 382 aa, Artificial Sequence
  Description of Artificial Sequence: Synthetic polypeptide
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 314 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 315 - protein, 382 aa, Artificial Sequence
  Description of Artificial Sequence: Synthetic polypeptide
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 316 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 317 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 318 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 319 - protein, 382 aa, Artificial Sequence
  Description of Artificial Sequence: Synthetic polypeptide
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 320 - protein, 382 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 321 - protein, 382 aa, Artificial Sequence
  Description of Artificial Sequence: Synthetic polypeptide
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSRLTVDKSRWQEGNVFSCSVMHEALHNHYTQKSLSLSLGK

SEQ ID NO: 322 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 323 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 324 - protein, 382 aa, Artificial Sequence
  Description of Artificial Sequence: Synthetic polypeptide
APTSSSTKKTQLQLEDLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 325 - protein, 382 aa, Artificial Sequence
  Description of Artificial Sequence: Synthetic polypeptide
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 326 - protein, 382 aa, Artificial Sequence
  Description of Artificial Sequence: Synthetic polypeptide
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 327 - protein, 382 aa, Artificial Sequence
  Description of Artificial Sequence: Synthetic polypeptide
APTSSSTKKTQLQLEHLLLDLQMILNGTNNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 328 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 329 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 330 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISLINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 331 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISSINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 332 - protein, 382 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 333 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 334 - protein, 382 aa, Artificial Sequence
  Description of Artificial Sequence: Synthetic polypeptide
APTSSSTKKTQLQLENLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 335 - protein, 382 aa, Artificial Sequence
  Description of Artificial Sequence: Synthetic polypeptide
APTSSSTKKTQLQLELLLLDLQMILNGINNYKNPELTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 336 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 337 - protein, 382 aa, Artificial Sequence
  Description of Artificial Sequence: Synthetic polypeptide
APTSSSTKKTQLQLEHLLLDLQMILNGINNYKNPELTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 338 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 339 - protein, 382 aa, Artificial Sequence
  Description of Artificial Sequence: Synthetic polypeptide
APTSSSTKKTQLQLENLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 340 - protein, 382 aa, Artificial Sequence
  Description of Artificial Sequence: Synthetic polypeptide
APTSSSTKKTQLQLELLLLDLQMILNGINNYKNPKLTQMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 341 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 342 - protein, 382 aa, Artificial Sequence
  Description of Artificial Sequence: Synthetic polypeptide
APTSSSTKKTQLQLEHLLLDLQMILNGINNYKNPKLTQMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 343 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 344 - protein, 382 aa, Artificial Sequence
  Description of Artificial Sequence: Synthetic polypeptide
APTSSSTKKTQLQLENLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 345 - protein, 382 aa, Artificial Sequence
  Description of Artificial Sequence: Synthetic polypeptide
APTSSSTKKTQLQLELLLLDLQMILNGINNYKNPKLTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 346 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 347 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 348 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 349 - protein, 382 aa, Artificial Sequence
  Description of Artificial Sequence: Synthetic polypeptide
APTSSSTKKTQLQLEHLLLDLQMILNGINNYKNPKLTRMLTKKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 350 - protein, 382 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 351 - protein, 382 aa, Artificial Sequence
  Description of Artificial Sequence: Synthetic polypeptide
APTSSSTKKTQLQLEHLLLDLQMILNGINNYKNPKLTRMLTAKFAMPKKATELKHLQCLEEELKPLEEALNGAPSKNFHLRPRDLISDINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 352 - protein, 382 aa, Artificial Sequence
  Description of Artificial Sequence: Synthetic polypeptide
APTSSSTKKTQLQLEHLLLDLQMILNGINNYKNPKLTNMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 353 - protein, 382 aa, Artificial Sequence
  Description of Artificial Sequence: Synthetic polypeptide
APTSSSTKKTQLQLENLLLDLQMILNGINNYKNPKLTEMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 354 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRVLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 355 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLIRNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 356 - protein, 382 aa, Artificial Sequence
  Description of Artificial Sequence: Synthetic polypeptide
APTSSSTKKTQLQLEHLLLDLQMILNGINNYKNPKLTEMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 357 - protein, 382 aa, Artificial Sequence
  Description of Artificial Sequence: Synthetic polypeptide
APTSSSTKKTQLQLENLLLDLQMILNGINNYKNPKLTRMLTQKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 358 - protein, 382 aa, Artificial Sequence
  Description of Artificial Sequence: Synthetic polypeptide
APTSSSTKKTQLQLEHLLLDLQMILNGINNYKNPKLTRMLTQKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 359 - protein, 382 aa, Artificial Sequence
  Description of Artificial Sequence: Synthetic polypeptide
APTSSSTKKTQLQLENLLLDLQMILNGINNYKNPELTNMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSESKYGPPCPPCPAPEFLGGPSVFLFPPKPKDTLMISRTPEVTCVVVDVSQEDPEVQFNWYVDGVEVHNAKTKPREEQFNSTYRVVSVLQVLHVDWLNGKEYKCKVSNKGLPSSIEKTISKAKGQPREPQVYTLPPSQEEMTKNQVSLTCLVKGFYPSDIVVEWESNGQPENNYKTTPPVLDSDGSFFLYSKLTVDKSRWQEGNVFSCSVMHEALHNHYTQKSLSLSLGK

SEQ ID NO: 360 - protein, 153 aa, Homo sapiens
MYRMQLLSCIALSLALVTNSAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 361 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 362 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 363 - DNA, 399 bp, Artificial Sequence
  Description of Artificial Sequence: Synthetic polynucleotide
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 364 - DNA, 399 bp, Artificial Sequence
  Description of Artificial Sequence: Synthetic polynucleotide
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 365 - DNA, 399 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 366 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 367 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 368 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 369 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 370 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 371 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 372 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 373 - DNA, 399 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 374 - DNA, 399 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 375 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 376 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 377 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 378 - DNA, 399 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 379 - DNA, 399 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 380 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 381 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 382 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 383 - DNA, 399 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 384 - DNA, 399 bp, Artificial Sequence
  Description of Artificial Sequence: Synthetic polynucleotide
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 385 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 386 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 387 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 388 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 389 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 390 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 391 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 392 - DNA, 399 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 393 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 394 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 395 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 396 - DNA, 399 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 397 - DNA, 399 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 398 - DNA, 399 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 399 - DNA, 681 bp, Homo sapiens
gataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 400 - DNA, 681 bp, Artificial Sequence
  Description of Artificial Sequence: Synthetic polynucleotide
gataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 401 - DNA, 681 bp, Artificial Sequence
  Description of Artificial Sequence: Synthetic polynucleotide
gataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 402 - DNA, 681 bp, Artificial Sequence
  Description of Artificial Sequence: Synthetic polynucleotide
gataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 403 - DNA, 681 bp, Artificial Sequence
  Description of Artificial Sequence: Synthetic polynucleotide
gataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 404 - DNA, 687 bp, Artificial Sequence
  Description of Artificial Sequence: Synthetic polynucleotide
gaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 405 - DNA, 687 bp, Artificial Sequence
  Description of Artificial Sequence: Synthetic polynucleotide
gaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 406 - DNA, 687 bp, Artificial Sequence
  Description of Artificial Sequence: Synthetic polynucleotide
gaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 407 - DNA, 687 bp, Artificial Sequence
  Description of Artificial Sequence: Synthetic polynucleotide
gaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 408 - DNA, 60 bp, Artificial Sequence
  Description of Artificial Sequence: Synthetic oligonucleotide
ggtggtggaggatcgggaggtggaggatctggaggaggaggatcgggtggaggaggatcc

SEQ ID NO: 409 - DNA, 108 bp, Artificial Sequence
  Description of Artificial Sequence: Synthetic polynucleotide
gcgggctcaggcggctcaggcggaagcggcgggtctccagtgccttcaacccctcccaccaattcaagctccaccccaccgacaccatcaccgtcagcctctggaagc

SEQ ID NO: 410 - DNA, 132 bp, Artificial Sequence
  Description of Artificial Sequence: Synthetic polynucleotide
gcaggaagtggcggatccggcggttctggtggttctcctgtgccttctactcctccaactcccagtccgagtaccccacccactccgtcaccttccggtggtagcggtaattctagtggcagtggcggatca

SEQ ID NO: 411 - DNA, 144 bp, Artificial Sequence
  Description of Artificial Sequence: Synthetic polynucleotide
gcaggctctgggaattcatccggctctggtggaagtggcgggtcaggtaattcaagcgggtctggcggtagccctgtgccatccacaccgccaactccatctccctctactcctccaacgccaagcccctcagcatccggatct

SEQ ID NO: 412 - DNA, 72 bp, Artificial Sequence
  Description of Artificial Sequence: Synthetic oligonucleotide
gcggaagcggcggctaaagaggcagccgctaaggaagcagccgctaaggaagcggcagcgaaggctggtagc

SEQ ID NO: 413 - DNA, 75 bp, Artificial Sequence
  Description of Artificial Sequence: Synthetic oligonucleotide
ggcaccaccccaaatcccccggccagtagctccaccacaggctcatccaccccaacgaaccccccggcaggttca

SEQ ID NO: 414 - DNA, 111 bp, Artificial Sequence
  Description of Artificial Sequence: Synthetic polynucleotide
gctgggtcacctggtgctggcaacggtggtaacaacggtggtaatcctcctcccccgactaccacgactagcagcgccccggctacgaccactacggcgtccgcagggtca

SEQ ID NO: 415 - DNA, 66 bp, Artificial Sequence
  Description of Artificial Sequence: Synthetic oligonucleotide
ggcggcggtagtgccggagggggatctgccggcggtggatcagcgggtggcggctctgcgggaagc

SEQ ID NO: 416 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 417 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 418 - DNA, 1140 bp, Artificial Sequence
  Description of Artificial Sequence: Synthetic polynucleotide
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 419 - DNA, 1140 bp, Artificial Sequence
  Description of Artificial Sequence: Synthetic polynucleotide
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 420 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 421 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 422 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 423 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 424 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 425 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 426 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 427 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 428 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 429 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 430 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 431 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 432 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 433 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 434 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 435 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 436 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 437 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 438 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 439 - DNA, 1140 bp, Artificial Sequence
  Description of Artificial Sequence: Synthetic polynucleotide
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 440 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 441 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 442 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 443 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 444 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 445 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 446 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 447 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 448 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 449 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 450 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 451 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 452 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 453 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 454 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 455 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 456 - DNA, 1140 bp, Artificial Sequence
  Description of Artificial Sequence: Synthetic polynucleotide
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 457 - DNA, 1140 bp, Artificial Sequence
  Description of Artificial Sequence: Synthetic polynucleotide
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 458 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 459 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 460 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 461 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 462 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 463 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 464 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 465 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 466 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 467 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 468 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 469 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 470 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 471 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 472 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 473 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 474 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 475 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 476 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 477 - DNA, 1140 bp, Artificial Sequence
  Description of Artificial Sequence: Synthetic polynucleotide
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 478 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 479 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 480 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 481 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 482 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 483 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 484 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 485 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 486 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 487 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 488 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 489 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 490 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 491 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcagggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgactgtgctgcaccaggactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 492 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 493 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 494 - DNA, 1140 bp, Artificial Sequence
  Description of Artificial Sequence: Synthetic polynucleotide
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 495 - DNA, 1140 bp, Artificial Sequence
  Description of Artificial Sequence: Synthetic polynucleotide
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 496 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 497 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 498 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 499 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 500 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 501 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 502 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 503 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 504 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 505 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 506 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 507 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 508 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 509 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 510 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 511 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 512 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 513 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 514 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 515 - DNA, 1140 bp, Artificial Sequence
  Description of Artificial Sequence: Synthetic polynucleotide
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 516 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 517 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 518 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 519 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 520 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 521 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 522 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 523 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 524 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 525 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 526 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 527 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 528 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 529 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacggttcgacatacagagtagtgagcgtcttgcaggtgctgcacgttgactggctcaacggaaaggagtataagtgtaaagtatcgaataaggcacttcccgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 530 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 531 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 532 - DNA, 1140 bp, Artificial Sequence
  Description of Artificial Sequence: Synthetic polynucleotide
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 533 - DNA, 1140 bp, Artificial Sequence
  Description of Artificial Sequence: Synthetic polynucleotide
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 534 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 535 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 536 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 537 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 538 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 539 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 540 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 541 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 542 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 543 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 544 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 545 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 546 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 547 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 548 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 549 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 550 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 551 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 552 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 553 - DNA, 1140 bp, Artificial Sequence
  Description of Artificial Sequence: Synthetic polynucleotide
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 554 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 555 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 556 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 557 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 558 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 559 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 560 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 561 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 562 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 563 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 564 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 565 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 566 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 567 - DNA, 1140 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggaggcagcaggtggtccttccgtattcttgtttccgccgaagccgaaggacacgcttatgattagcaggactcccgaagtgacgtgcgtcgtagtcgacgtgtcgcatgaggacccggaggtcaagttcaactggtatgtcgatggcgtagaagtacacaatgcaaagactaaaccccgcgaagaacagtacaattcgacatacagagtagtgagcgtcttgcaggtgctgcacgttgactggctcaacggaaaggagtataagtgtaaagtatcgaataaggcacttggtgcacctatcgagaaaacgatctccaaggctaagggtcagccaagagaaccccaagtctacactctgccccctagccgcgacgagcttacgaaaaaccaggtgtcgctcacttgtttggtgaagggtttctatccgagcgatattgtggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 568 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 569 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 570 - DNA, 1146 bp, Artificial Sequence
  Description of Artificial Sequence: Synthetic polynucleotide
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 571 - DNA, 1146 bp, Artificial Sequence
  Description of Artificial Sequence: Synthetic polynucleotide
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 572 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 573 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 574 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 575 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 576 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 577 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 578 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 579 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 580 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 581 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 582 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 583 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 584 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 585 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 586 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 587 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 588 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 589 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 590 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 591 - DNA, 1146 bp, Artificial Sequence
  Description of Artificial Sequence: Synthetic polynucleotide
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 592 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 593 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 594 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 595 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 596 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 597 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 598 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 599 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 600 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 601 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 602 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 603 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 604 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 605 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 606 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 607 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 608 - DNA, 1146 bp, Artificial Sequence
  Description of Artificial Sequence: Synthetic polynucleotide
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 609 - DNA, 1146 bp, Artificial Sequence
  Description of Artificial Sequence: Synthetic polynucleotide
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 610 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 611 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 612 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 613 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 614 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 615 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 616 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 617 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 618 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 619 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 620 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 621 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 622 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 623 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 624 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 625 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 626 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 627 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 628 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 629 - DNA, 1146 bp, Artificial Sequence
  Description of Artificial Sequence: Synthetic polynucleotide
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 630 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 631 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 632 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 633 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 634 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 635 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 636 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 637 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 638 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 639 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 640 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 641 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 642 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 643 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttacagtcttgcaccaagattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgctgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 644 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 645 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 646 - DNA, 1146 bp, Artificial Sequence
  Description of Artificial Sequence: Synthetic polynucleotide
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 647 - DNA, 1146 bp, Artificial Sequence
  Description of Artificial Sequence: Synthetic polynucleotide
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 648 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 649 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 650 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 651 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 652 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 653 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 654 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 655 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 656 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 657 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 658 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 659 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 660 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 661 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 662 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 663 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 664 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 665 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 666 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 667 - DNA, 1146 bp, Artificial Sequence
  Description of Artificial Sequence: Synthetic polynucleotide
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 668 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 669 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 670 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 671 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 672 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 673 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 674 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 675 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 676 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 677 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 678 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 679 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 680 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 681 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcagattgacggtagacaaaagccgctggcaagagggcaatgtcttcagttgttctgtaatgcacgaagccctccataatcactacacgcagaaatctctgagcttgtctcttgggaaa

SEQ ID NO: 682 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagtattgaatcttgctcagtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 683 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 684 - DNA, 1146 bp, Artificial Sequence
  Description of Artificial Sequence: Synthetic polynucleotide
gcccctacgtcctcctcaactaaaaagacgcaacttcagcttgaggatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 685 - DNA, 1146 bp, Artificial Sequence
  Description of Artificial Sequence: Synthetic polynucleotide
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 686 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 687 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaaccaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 688 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagttctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 689 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgatacgtaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 690 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcctgatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 691 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcagcatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 692 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 693 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 694 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 695 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 696 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 697 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctgaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 698 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 699 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 700 - DNA, 1146 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 701 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtgctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 702 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactcagatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 703 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 704 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 705 - DNA, 1146 bp, Artificial Sequence
  Description of Artificial Sequence: Synthetic polynucleotide
gcccctacgtcctcctcaactaaaaagacgcaacttcagcttgagttgcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 706 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 707 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 708 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 709 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgaagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 710 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 711 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacggcaaagtttgctatgccaaaaaaggccactgagttgaaacaccttcaatgcttggaggaggaacttaaaccacttgaggaagccttgaatggtgctccgtccaaaaactttcatttgcggccacgagatctgataagcgatatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 712 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 713 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 714 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagtcctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 715 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataaggaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 716 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactgaaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 717 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 718 - DNA, 1146 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgcagaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 719 - DNA, 1146 bp, Artificial Sequence
  Description of Artificial Sequence: Synthetic polynucleotide
gcccctacgtcctcctcaactaaaaagacgcaacttcagcttgagaaccttcttctcgaccttcagatgattttgaacggaatcaataattacaaaaatcctgaacttactaacatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgaaagtaagtatggccctccttgccctccgtgccctgcacctgagttcctcggcggtccttcagtgtttttgtttccacccaaacctaaagacacccttatgatctctcgaacacctgaagtaacctgtgtagttgttgatgtctcacaggaagatccggaggttcaatttaattggtacgtcgatggtgttgaagtgcataatgcgaagactaagccgagagaggaacagttcaattccacttatcgcgtggtttcagtccttcaggtcttgcacgtggattggcttaacggaaaggaatataagtgcaaggtaagtaataaagggcttccatcaagcattgaaaaaaccataagtaaagcaaaaggacaaccgagggagccccaagtctacacgcttcctccttctcaggaggagatgaccaaaaaccaggtaagtttgacgtgtttggtaaaggggttttatccctcagatattgttgtcgaatgggagtctaatggtcagcctgagaacaattacaagactacgccacccgttctggattcagacggatctttcttcctctacagcaaattgacggtagacaaaagccgctggcaagagggcaatgtcttcagttgttctgtaatgcacgaagccctccataatcactacacgcagaaatctctgagcttgtctcttgggaaa

SEQ ID NO: 720-999 - skipped (280 entries)

SEQ ID NO: 1000 - protein, 133 aa, Artificial Sequence
  Description of Artificial Sequence: Synthetic polypeptide
APASSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 1001 - protein, 133 aa, Artificial Sequence
  Description of Artificial Sequence: Synthetic polypeptide
APASSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLT

SEQ ID NO: 1002 - protein, 133 aa, Artificial Sequence
  Description of Artificial Sequence: Synthetic polypeptide
APASSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLT

SEQ ID NO: 1003 - protein, 227 aa, Artificial Sequence
  Description of Artificial Sequence: Synthetic polypeptide
DKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1004 - protein, 380 aa, Artificial Sequence
  Description of Artificial Sequence: Synthetic polypeptide
APASSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1005 - protein, 380 aa, Artificial Sequence
  Description of Artificial Sequence: Synthetic polypeptide
APASSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1006 - protein, 380 aa, Artificial Sequence
  Description of Artificial Sequence: Synthetic polypeptide
APASSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1007 - protein, 380 aa, Artificial Sequence
  Description of Artificial Sequence: Synthetic polypeptide
APTSSSTKKTQLQLENLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1008 - protein, 380 aa, Artificial Sequence
  Description of Artificial Sequence: Synthetic polypeptide
APTSSSTKKTQLQLELLLLDLQMILNGINNYKNPKLTRMLTFKFYMPKKATELKHLQCLEEELKPLEEALNLAPSKNFHLRPRDLISNINVIVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1009 - protein, 380 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEALNLAPSKNFHLRPRDLISNINVSVLELKGSETTFMCEYADETATIVEFLNRWITFSQSIISTLTGGGGSGGGGSGGGGSGGGGSDKTHTCPPCPAPELLGGPSVFLFPPKPKDTLMISRTPEVTCVVVDVSHEDPEVKFNWYVDGVEVHNAKTKPREEQYGSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1010 - DNA, 399 bp, Artificial Sequence
  Description of Artificial Sequence: Synthetic polynucleotide
gcccctgcatcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 1011 - DNA, 399 bp, Artificial Sequence
  Description of Artificial Sequence: Synthetic polynucleotide
gcccctgcatcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 1012 - DNA, 399 bp, Artificial Sequence
  Description of Artificial Sequence: Synthetic polynucleotide
gcccctgcatcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgact

SEQ ID NO: 1013 - DNA, 681 bp, Artificial Sequence
  Description of Artificial Sequence: Synthetic polynucleotide
gataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1014 - DNA, 1140 bp, Artificial Sequence
  Description of Artificial Sequence: Synthetic polynucleotide
gcccctgcatcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1015 - DNA, 1140 bp, Artificial Sequence
  Description of Artificial Sequence: Synthetic polynucleotide
gcccctgcatcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1016 - DNA, 1140 bp, Artificial Sequence
  Description of Artificial Sequence: Synthetic polynucleotide
gcccctgcatcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1017 - DNA, 1140 bp, Artificial Sequence
  Description of Artificial Sequence: Synthetic polynucleotide
gcccctacgtcctcctcaactaaaaagacgcaacttcagcttgagaatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1018 - DNA, 1140 bp, Artificial Sequence
  Description of Artificial Sequence: Synthetic polynucleotide
gcccctacgtcctcctcaactaaaaagacgcaacttcagcttgagctgcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgatcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1019 - DNA, 1140 bp, Artificial Sequence
  Description of Artificial Sequence: Synthetic polynucleotide
gcccctacgtcctcctcaactaaaaagacgcaacttcagcttgagcatcttcttctcgaccttcagatgattttgaacggaatcaataattacaaaaatcctaaacttactagaatgctcacgtttaagttttatatgccaaaaaaggccactgagttgaaacaccttcaatgcttggaggaggaacttaaaccacttgaggaagccttgaatcttgctccgtccaaaaactttcatttgcggccacgagatctgataagcaacatcaacgtgagcgtcctggaactgaaaggaagcgaaacgacgtttatgtgcgaatatgcagacgaaactgcgacaatcgttgaatttctcaatcgatggatcacttttagccaatctatcatcagcacgttgactggtggtggaggatcgggaggtggaggatctggaggaggaggatcgggtggaggaggatccgataaaactcatacgtgcccaccctgccccgcaccggagctgcttgggggtccttccgtattcttgtttccgccgaagccgaaggacacgcttatgattagcaggactcccgaagtgacgtgcgtcgtagtggacgtgtcgcatgaggacccggaggtcaagttcaactggtatgtcgatggcgtagaagtacacaatgcaaagactaaaccccgcgaagaacagtacggttcgacatacagagtagtgagcgtcttgactgtgctgcaccaggactggctcaacggaaaggagtataagtgtaaagtatcgaataaggcacttcccgcacctatcgagaaaacgatctccaaggctaagggtcagccaagagaaccccaagtctacactctgccccctagccgcgaagagatgacgaaaaaccaggtgtcgctcacttgtttggtgaagggtttctatccgagcgatattgcggtagagtgggaatccaacgggcagccagagaacaattacaagacgacgccaccagtgctggattcggatgggagctttttcttgtactcaaagttgaccgtggataaaagccggtggcagcagggtaatgtgttttcatgctcggtaatgcacgaggccctccataaccattatacgcagaaaagcctttcgctctcacccgggaaa

SEQ ID NO: 1020 - protein, 30 aa, Artificial Sequence
  Description of Artificial Sequence: Synthetic polypeptide
  MISC_FEATURE (1)..(30): This sequence may encompass 1-6 "Gly Gly Gly Gly Ser" repeating units
  See specification as filed for detailed description of substitutions and preferred embodiments
GGGGSGGGGSGGGGSGGGGSGGGGSGGGGS

SEQ ID NO: 1021 - protein, 27 aa, Artificial Sequence
  Description of Artificial Sequence: Synthetic peptide
  MISC_FEATURE (2)..(26): This region may encompass 2-5 "Glu Ala Ala Ala Lys" repeating units
  See specification as filed for detailed description of substitutions and preferred embodiments
AEAAAKEAAAKEAAAKEAAAKEAAAKA

SEQ ID NO: 1022 - protein, 25 aa, Artificial Sequence
  Description of Artificial Sequence: Synthetic peptide
  MISC_FEATURE (1)..(25): This sequence may encompass 1-5 "Gly Gly Gly Ser Ala" repeating units
  See specification as filed for detailed description of substitutions and preferred embodiments
GGGSAGGGSAGGGSAGGGSAGGGSA

SEQ ID NO: 1023 - protein, 5 aa, Artificial Sequence
  Description of Artificial Sequence: Synthetic peptide
GGGGS

SEQ ID NO: 1024 - protein, 10 aa, Artificial Sequence
  Description of Artificial Sequence: Synthetic peptide
GGGGSGGGGS

SEQ ID NO: 1025 - protein, 15 aa, Artificial Sequence
  Description of Artificial Sequence: Synthetic peptide
GGGGSGGGGSGGGGS

SEQ ID NO: 1026 - protein, 25 aa, Artificial Sequence
  Description of Artificial Sequence: Synthetic peptide
GGGGSGGGGSGGGGSGGGGSGGGGS

SEQ ID NO: 1027 - protein, 30 aa, Artificial Sequence; identical to SEQ ID NO: 1020
  Description of Artificial Sequence: Synthetic polypeptide

SEQ ID NO: 1028 - protein, 6 aa, Artificial Sequence
  Description of Artificial Sequence: Synthetic 6xHis tag
HHHHHH

SEQ ID NO: 1029 - protein, 5 aa, Artificial Sequence
  Description of Artificial Sequence: Synthetic peptide
GGGGS

SEQ ID NO: 1030 - protein, 135 aa, Artificial Sequence
  Description of Artificial Sequence: Synthetic polypeptide
APTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLTGS

SEQ ID NO: 1031 - protein, 133 aa, Homo sapiens [sequence omitted]

SEQ ID NO: 1032 - protein, 133 aa, Artificial Sequence
  Description of Artificial Sequence: Synthetic polypeptide
  MOD_RES (3)..(3): T or A
  MOD_RES (16)..(16): H, L, or N
  MOD_RES (28)..(28): I, T, or F
  MOD_RES (35)..(35): K or E
  MOD_RES (38)..(38): R, E, N, or Q
  MOD_RES (42)..(42): F, A, K, or Q
  MOD_RES (68)..(68): E, Q, or N
  MOD_RES (69)..(69): V or A
  MOD_RES (74)..(74): Q or P
  MOD_RES (84)..(84): D or V
  MOD_RES (87)..(87): S or R
  MOD_RES (88)..(88): N, D, L, or S
  MOD_RES (92)..(92): I or S
  MOD_RES (125)..(125): C or S
  MOD_RES (126)..(126): Q, K, R, or T
APXSSSTKKTQLQLEXLLLDLQMILNGXNNYKNPXLTXMLTXKFYMPKKATELKHLQCLEEELKPLEXXLNLAXSKNFHLRPRXLIXXINVXVLELKGSETTFMCEYADETATIVEFLNRWITFXXSIISTLT

The invention claimed is:

1. An interleukin-2 (IL-2) variant comprising an amino acid sequence having at least 95% sequence identity to SEQ ID NO:1031 and
   (i) an amino acid substitution H16L, H16N, or I92S, and
   (ii) amino acid substitutions V69A, Q74P, and C125S.

2. The IL-2 variant of claim 1, further comprising an amino acid substitution T3A.

3. The IL-2 variant of claim 1, comprising an amino acid sequence of any one of SEQ ID NOs: 4, 5, 11, 1000, 1001, or 1002.

4. The IL-2 variant of claim 1, which selectively stimulates regulatory T cells (Tregs).

5. A pharmaceutical composition comprising the IL-2 variant of claim 1 and a pharmaceutically acceptable carrier.

6. A kit comprising the IL-2 variant of claim 1 and instructions for use.

7. The IL-2 variant of claim 1, comprising the amino acid substitutions H16N, V69A, Q74P, and C125S.

8. The IL-2 variant of claim 1, comprising the amino acid substitutions H16L, V69A, Q74P, and C125S.

9. The IL-2 variant of claim 1, comprising the amino acid substitutions V69A, Q74P, I92S, and C125S.

10. The IL-2 variant of claim 1, comprising the amino acid substitutions T3A, H16N, V69A, Q74P, and C125S.

11. The IL-2 variant of claim 1, comprising the amino acid substitutions T3A, H16L, V69A, Q74P, and C125S.

12. The IL-2 variant of claim 1, comprising the amino acid substitutions T3A, V69A, Q74P, I92S, and C125S.

13. The IL-2 variant of claim 3, comprising the amino acid sequence of SEQ ID NO: 4.

14. The IL-2 variant of claim 3, comprising the amino acid sequence of SEQ ID NO: 11.

15. The IL-2 variant of claim 3, comprising the amino acid sequence of SEQ ID NO: 1000.

16. The IL-2 variant of claim 3, comprising the amino acid sequence of SEQ ID NO: 1001.

17. The IL-2 variant of claim 3, comprising the amino acid sequence of SEQ ID NO: 1002.

18. An interleukin-2 (IL-2) variant comprising an amino acid sequence having at least 95% sequence identity to SEQ ID NO:1 and
   (i) an amino acid substitution H16L, H16N, or I92S, and
   (ii) amino acid substitutions V69A and Q74P.

19. The IL-2 variant of claim 18, comprising the amino acid substitutions H16L, V69A, and Q74P.

20. The IL-2 variant of claim 18, further comprising an amino acid substitution T3A.

21. A pharmaceutical composition comprising the IL-2 variant of claim 18 and a pharmaceutically acceptable carrier.

22. A kit comprising the IL-2 variant of claim 18.

23. The IL-2 variant of claim 18, comprising the amino acid sequence of SEQ ID NO: 5.

* * * * *

UNITED STATES PATENT AND TRADEMARK OFFICE
CERTIFICATE OF CORRECTION

PATENT NO. : 12,084,484 B2  
APPLICATION NO. : 16/937993  
DATED : September 10, 2024  
INVENTOR(S) : Carlson et al.

Page 1 of 1

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 295 days.

Signed and Sealed this
Twenty-ninth Day of April, 2025

Coke Morgan Stewart
*Acting Director of the United States Patent and Trademark Office*